United States Patent
Zhan et al.

(10) Patent No.: US 10,772,940 B1
(45) Date of Patent: Sep. 15, 2020

(54) COCAINE HYDROLASE-FC FUSION PROTEINS FOR COCAINE AND METHODS FOR UTILIZING THE SAME

(71) Applicant: University of Kentucky Research Foundation, Lexington, KY (US)

(72) Inventors: Chang-Guo Zhan, Lexington, KY (US); Fang Zheng, Lexington, KY (US); Hsin-Hsiung Tai, Lexington, KY (US); Xiabin Chen, Lexington, KY (US); Liu Xue, Lexington, KY (US); Shurong Hou, Lexington, KY (US)

(73) Assignee: University of Kentucky Research Foundation, Lexington, KY (US)

(*) Notice: Subject to any disclaimer, the term of this patent is extended or adjusted under 35 U.S.C. 154(b) by 0 days.

(21) Appl. No.: 14/102,977

(22) Filed: Dec. 11, 2013

Related U.S. Application Data

(60) Provisional application No. 61/735,719, filed on Dec. 11, 2012.

(51) Int. Cl.
*C12N 9/14* (2006.01)
*C12N 9/18* (2006.01)
*A61K 38/46* (2006.01)

(52) U.S. Cl.
CPC .............. *A61K 38/465* (2013.01); *C12N 9/14* (2013.01); *C12N 9/18* (2013.01)

(58) Field of Classification Search
CPC ................................ C12N 9/14; C12N 9/18
See application file for complete search history.

(56) References Cited

U.S. PATENT DOCUMENTS

| | | | |
|---|---|---|---|
| 7,438,904 B1 * | 10/2008 | Zhan et al. | 424/94.6 |
| 7,731,957 B1 | 6/2010 | Zhan et al. | |
| 7,740,840 B1 | 6/2010 | Zhan et al. | |
| 7,892,537 B1 | 2/2011 | Zhan et al. | |
| 7,919,082 B1 | 4/2011 | Zhan et al. | |
| 8,193,327 B1 | 6/2012 | Zhan et al. | |
| 8,206,703 B1 | 6/2012 | Zhan et al. | |
| 8,399,644 B1 | 3/2013 | Zhan et al. | |
| 2011/0002888 A1 | 1/2011 | Rosen et al. | |

FOREIGN PATENT DOCUMENTS

WO    WO2010088444    * 5/2010    ........... A61K 39/395

OTHER PUBLICATIONS

Peters et al, Prolonged activity of factor IX as a monomeric Fc fusion protein. Blood, Mar. 11, 2010 _ vol. 115, No. 10 p. 2057-2064.*
Issued Patents Database from Zhan et al, 2008, U.S. Pat. No. 7,438,904 SEQ ID No. 20. Alignment with SEQ ID No. 50.*
A_Geneseq_201515 Database Acc#AYG52723 from Bowen et al, 2010 WO2010088444 SEQ ID No. 9. Alignment with SEQ ID No. 18.*
Harris et al, Coupling complement regulators to immunoglobulin domains generates effective anti-complement reagents with extended half-life in vivo. Clin Exp Immunol 2002; 129:198-207.*
Glaesner et al, Engineering and characterization of the long-acting glucagon-like peptide-1 analogue LY2189265, an Fc fusion protein. Diabetes Metab Res Rev 2010; 26: 287-296.*
Dumont et al, Prolonged activity of a recombinant factor VIII-Fc fusion protein in hemophiliaA mice and dogs. Blood, Mar. 29, 2012 _ vol. 119, No. 13.*
GenBank Acc# CAA49866 Filpula, *H. sapiens* mRNA for immunoglobulin G1, Fc fragment Mar. 15, 2001. Alignment with SEQ ID No. 2.*
GenBank Acc# CAA49866 Filpula, *H. sapiens* mRNA for immunoglobulin G1, Fc fragment Mar. 15, 2001. Alignment with SEC ID No. 2.*
Rath et al, Fc-fusion proteins and FcRn: structural insights for longer-lasting and more effective therapeutics. Critical Reviews in Biotechnology vol. 35, 2015—Issue 2 Published online: Oct. 24, 2013.*
Rath et al, supplementat information from Critical Reviews in Biotechnology vol. 35, 2015—Issue 2 Published online: Oct. 24, 2013.*
Declaration of Feb. 2, 2018 color copy. Provided to the examiner by email on Apr. 13, 2018.*
Rutishauser, et al., Amino Acid Sequence of the Fc Region of a Human Immunoglobulin; Biochemistry; vol. 61; 1968; pp. 1414-1421.
Brimijoin, et al.; A Cocaine Hydrolast Engineered from Human Butyrylcholinesterase Selectively Blocks Cocaine Toxicity and Reinstatement of Drug Seeking in Rats; Neuropsychopharmacology; 33(11); Oct. 2008; pp. 2715-2725.
Lazar, et al., Engineered antibody Fc variants with enhanced effector function; PNAS; vol. 103(11); 2006; pp 4005-4010.
Braman, J.; Papworth, C.; Greener, A. "Site-directed mutagenesis using double-stranded plasmid DNA templates", Methods Mol. Biol. 1996, 57, 31-44.
Gao, Y.; LaFleur, D.; Shah, R.; Zhao, Q.; Singh, M.; Brimijoin, S. "An albumin-butyrylcholinesterase for cocaine toxicity and addiction: catalytic and pharmacokinetic properties", Chem Biol Interact. 2008, 175, 83-87.

(Continued)

*Primary Examiner* — Sheridan Swope
(74) *Attorney, Agent, or Firm* — Stites & Harbison PLLC; Sean P. Ritchie; Mandy Wilson Decker

(57) ABSTRACT

The presently-disclosed subject matter includes isolated polypeptides that comprise a butyrylcholinestrase (BChE) polypeptide and a second polypeptide. The BChE polypeptide as well as the second polypeptide can be variants and/or fragments thereof. The presently-disclosed subject matter also includes a pharmaceutical composition that comprises the present isolated polypeptide and a suitable pharmaceutical carrier. Further still, methods are provided for treating cocaine-induced conditions, and comprise administering the isolated polypeptide and/or pharmaceutical compositions thereof to an individual.

7 Claims, 1 Drawing Sheet
Specification includes a Sequence Listing.

(56) References Cited

OTHER PUBLICATIONS

Zheng, F.; Zhan, C.-G. "Modeling of Pharmacokinetics of cocaine in Human reveals the feasibility for development of enzyme therapies for drugs of abuse", PLoS Comput. Biol. 2012, 8(7): e1002610. Epub Jul. 26, 2012.

Kronman, C.; Chitlaru, T.; Elhanany, E.; Velan, B.; Shafferman, A. "Hierarchy of post-translational modifications involved in the circulatory longevity of glycoproteins. Demonstration of concerted contributions of glycan sialylation and subunit assembly to the pharmacokinetic behavior of bovine acetylcholinesterase", J Biol Chem. 2000, 275:29488-29502.

Xue, L.; Hou, S.; Tong, M.; Fang, L.; Chen, X.; Jin, Z.; Tai, H.-H.; Zheng, F.; Zhan, C.-G. "Preparation and in vivo characterization of a cocaine hydrolase engineered from human butyrylcholinesterase for metabolizing cocaine", Biochem. J. 2013, 453, 447-454.

\* cited by examiner

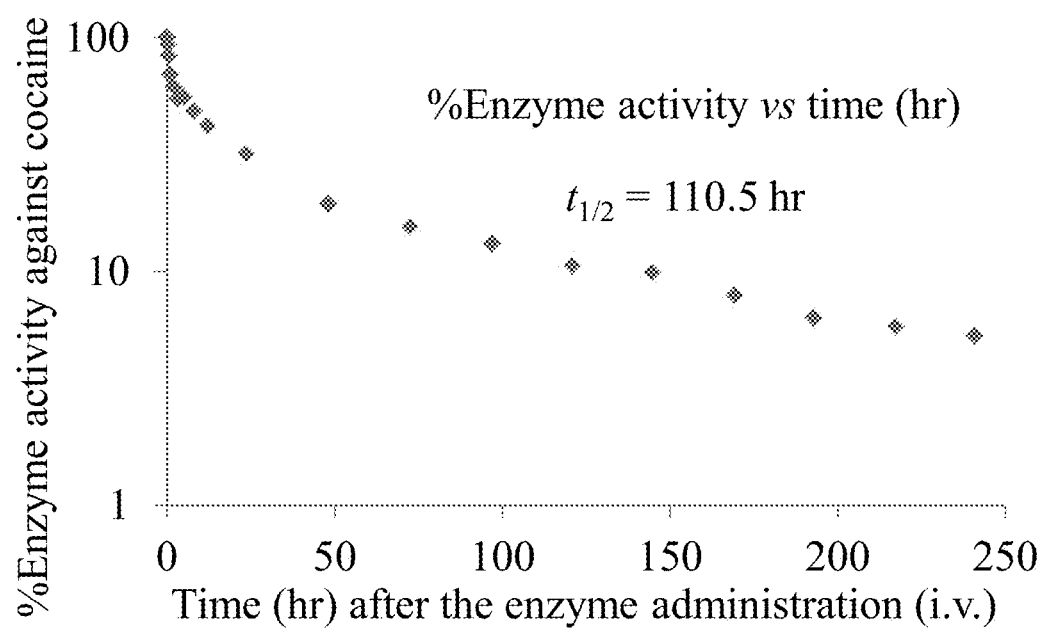

COCAINE HYDROLASE-FC FUSION PROTEINS FOR COCAINE AND METHODS FOR UTILIZING THE SAME

RELATED APPLICATIONS

This application claims priority from U.S. Provisional Patent Application No. 61/735,719, filed Dec. 11, 2012, the entire disclosure of which is incorporated herein by this reference.

GOVERNMENT INTEREST

This invention was made with government support under Grant Numbers R01DA013930, R01DA035552, and R01DA032910 awarded by the National Institute on Drug Abuse (NIDA) of the National Institutes of Health (NIH). The government has certain rights in the invention.

TECHNICAL FIELD

The presently-disclosed subject matter relates to polypeptides comprising butyrylcholinesterase (BChE) and one or more other polypeptides. In particular, the presently-disclosed subject matter relates to isolated polypeptides comprising a BChE variant and a second polypeptide variant.

INTRODUCTION

Cocaine abuse is a major medical and public health problem that continues to defy treatment. The disastrous medical and social consequences of cocaine addiction, such as violent crime, loss in individual productivity, illness, and death, have made the development of an effective pharmacological treatment a high priority. However, cocaine mediates its reinforcing and toxic effects by blocking neurotransmitter reuptake and the classical pharmacodynamic approach has failed to yield small-molecule receptor antagonists due to the difficulties inherent in blocking a blocker. An alternative to receptor-based approaches is to interfere with the delivery of cocaine to its receptors and accelerate its metabolism in the body.

The dominant pathway for cocaine metabolism in primates is butyrylcholinesterase (BChE)-catalyzed hydrolysis at the benzoyl ester group (Scheme 1).

Scheme 1. Schematic representation of BChE-catalyzed hydrolysis at the benzoyl ester group.

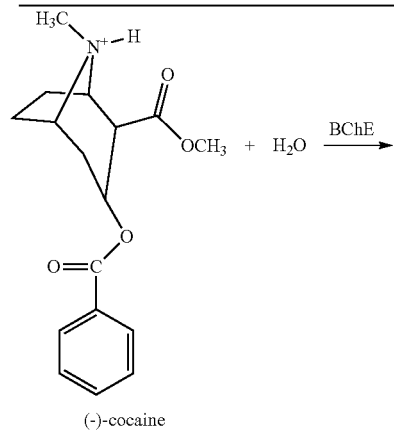

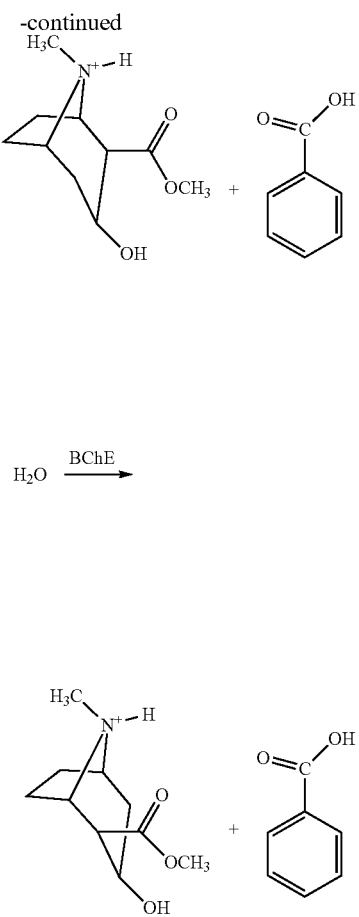

Only 5% of the cocaine is deactivated through oxidation by the liver microsomal cytochrome P450 system. Cocaine hydrolysis at benzoyl ester group yields ecgonine methyl ester, whereas the oxidation produces norcocaine. The metabolite ecgonine methyl ester is a biologically inactive metabolite, whereas the metabolite norcocaine is hepatotoxic and a local anesthetic. BChE is synthesized in the liver and widely distributed in the body, including plasma, brain, and lung. Extensive experimental studies in animals and humans demonstrate that enhancement of BChE activity by administration of exogenous enzyme substantially decreases cocaine half-life.

Enhancement of cocaine metabolism by administration of BChE has been recognized to be a promising pharmacokinetic approach for treatment of cocaine abuse and dependence. However, the catalytic activity of this plasma enzyme is three orders-of-magnitude lower against the naturally occurring (−)-cocaine than that against the biologically inactive (+)-cocaine enantiomer. (+)-cocaine can be cleared from plasma in seconds and prior to partitioning into the central nervous system (CNS), whereas (−)-cocaine has a plasma half-life of approximately 45-90 minutes (for a relatively low dose of cocaine), long enough for manifestation of the CNS effects which peak in minutes. Under the overdose condition, BChE is saturated with (−)-cocaine and, thus, the plasma half-life of (−)-cocaine will be longer.

Furthermore, recombinant human BChE is quickly eliminated from the circulation relative to native human BChE that can be purified from human plasma. For instance, it has been observed that recombinant human BChE only has a relatively short half-life of about 15 minutes to about 8 hours in humans. Therefore, while known recombinant human BChE may be suitable for administration over shorter time periods, which can be the case when seeking overdose relief, recombinant BChE less desirable for rehabilitation and other treatments, which are best accomplished with more consistent doses of BChE that administered over relatively longer time periods. Without being bound by theory or mechanism, these differences in half-life between known recombinant human BChE and native human BChE is caused by particular posttranslational modifications of native human BChE, including oligomerization and glycosylation.

Hence, BChE mutants with high activity against (−)-cocaine are highly desired for use in humans. BChE mutants having a relatively longer half-life are also highly desired, particularly for use in cocaine rehabilitation treatments and the like.

SUMMARY

The presently-disclosed subject matter meets some or all of the above-identified needs, as will become evident to those of ordinary skill in the art after a study of information provided in this document.

This Summary describes several embodiments of the presently-disclosed subject matter, and in many cases lists variations and permutations of these embodiments. This Summary is merely exemplary of the numerous and varied embodiments. Mention of one or more representative features of a given embodiment is likewise exemplary. Such an embodiment can typically exist with or without the feature(s) mentioned; likewise, those features can be applied to other embodiments of the presently-disclosed subject matter, whether listed in this Summary or not. To avoid excessive repetition, this Summary does not list or suggest all possible combinations of such features.

The presently-disclosed subject matter includes an isolated polypeptide comprising a butyrylcholinesterase (BChE) polypeptide and a second polypeptide. In some embodiments the BChE polypeptide is a BChE polypeptide variant that comprises an amino acid sequence selected from SEQ ID NOS: 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, and 134 as set forth herein. In some embodiments the provided BChE polypeptide is a BChE polypeptide fragment. Also, in some embodiments the second polypeptide is a second polypeptide variant comprising an amino acid sequence selected from SEQ ID NOS: 6, 8, 10, 12, 14, 16, 18, 20, 22, and 24, as set forth herein. In some embodiments the provided second polypeptide is a second polypeptide fragment.

The presently-disclosed subject matter further includes isolated nucleic acid molecules that encode an isolated polypeptide that comprises a BChE polypeptide and a second polypeptide. In some embodiments the nucleic acid sequence encodes a BChE polypeptide variant, and the nucleic acid sequence is selected from SEQ ID NOS: 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, and 133, as set forth herein. Also, in some embodiments the nucleic acid sequence encodes a second polypeptide variant, and the nucleic acid sequence is selected from SEQ ID NOS: 5, 7, 9, 11, 13, 15, 17, 19, 21, and 23, as set forth herein.

Still further, in some embodiments of the isolated polypeptide there is provided a linker disposed between the BChE polypeptide and the second polypeptide. In some embodiments the linker comprises about 1 to about 7 amino acids.

The presently-disclosed subject matter also comprises a pharmaceutical composition that includes an isolated polypeptide, which includes a BChE polypeptide and a second polypeptide, or variants and/or fragments thereof, as well as a suitable pharmaceutical carrier.

The presently-disclosed subject matter further includes a method of treating a cocaine-induced condition, which includes administering to an individual an effective amount of an isolated polypeptide or a pharmaceutical composition comprising an isolated polypeptide, as described herein, to lower blood cocaine concentration in a subject. In some embodiments, the isolated polypeptide has a biological half-life of about 4 days to about 40 days in humans.

BRIEF DESCRIPTION OF THE DRAWINGS

FIG. 1 includes a chart showing the catalytic activity (%) 240 hours after administration of an isolated polypeptide including a BChE polypeptide variant (SEQ ID NO: 48) fused to a second polypeptide variant (SEQ ID NO: 6). No linker is included in this isolated polypeptide. The isolated polypeptide has a SEQ ID NO: 156, which includes a fragment having amino acids 1-529 and the following amino acid substitutions, as compared to wild type BChE: A199S, F227A, S287G, A328W, and Y332G (SEQ ID NO: 48), and a second polypeptide variant having the following amino acid substitutions, as compared to wild type second polypeptide: A1V, D142E, and L144M (SEQ ID NO: 6). Rat blood samples were collected from animals at various time points after the fusion protein injection. Then the enzyme activity of the serum against cocaine was measured in vitro.

BRIEF DESCRIPTION OF THE SEQUENCE LISTING

SEQ ID NO: 1 is a nucleotide sequence encoding a wild type second polypeptide of SEQ ID NO: 2;

SEQ ID NO: 2 is an amino acid sequence encoding a wild type second polypeptide;

SEQ ID NO: 3 is a nucleotide sequence encoding a wild type second polypeptide fragment of SEQ ID NO: 4;

SEQ ID NO: 4 is an amino acid sequence encoding a wild type second polypeptide fragment polypeptide wherein 16 amino acid residues are deleted from the N-terminus;

SEQ ID NO: 5 is a nucleotide sequence encoding a second polypeptide variant of SEQ ID NO: 6;

SEQ ID NO: 6 is an amino acid sequence encoding a second polypeptide variant having the following amino acid substitutions, as compared to wild type second polypeptide: A1V, D142E, and L144M;

SEQ ID NO: 7 is a nucleotide sequence encoding a second polypeptide variant of SEQ ID NO: 8;

SEQ ID NO: 8 is an amino acid sequence encoding a second polypeptide variant having the following amino acid substitutions, as compared to wild type second polypeptide: A1V, E58Q, E69Q, E80Q, D98N, N101D, D142E, and L144M;

SEQ ID NO: 9 is a nucleotide sequence encoding a second polypeptide variant of SEQ ID NO: 10;

SEQ ID NO: 10 is an amino acid sequence encoding a second polypeptide variant having the following amino acid substitutions, as compared to wild type second polypeptide: A1Q, C6S, C12S, C15S, and P24S;

SEQ ID NO: 11 is a nucleotide sequence encoding a second polypeptide variant of SEQ ID NO: 12;

SEQ ID NO: 12 is an amino acid sequence encoding a second polypeptide variant having the following amino acid substitutions, as compared to wild type second polypeptide: A1V, M38Y, D142E, and L144M;

SEQ ID NO: 13 is a nucleotide sequence encoding a second polypeptide variant of SEQ ID NO: 14;

SEQ ID NO: 14 is an amino acid sequence encoding a second polypeptide variant having the following amino acid substitutions, as compared to wild type second polypeptide: A1V, T42E, D142E, and L144M;

SEQ ID NO: 15 is a nucleotide sequence encoding a second polypeptide variant of SEQ ID NO: 16;

SEQ ID NO: 16 is an amino acid sequence encoding a second polypeptide variant having the following amino acid substitutions, as compared to wild type second polypeptide: A1V, M38Y, S40T, D142E, and L144M;

SEQ ID NO: 17 is a nucleotide sequence encoding a second polypeptide variant of SEQ ID NO: 18;

SEQ ID NO: 18 is an amino acid sequence encoding a second polypeptide variant having the following amino acid substitutions, as compared to wild type second polypeptide: A1V, M38Y, S40T, T42E, D142E, and L144M;

SEQ ID NO: 19 is a nucleotide sequence encoding a second polypeptide variant of SEQ ID NO: 20;

SEQ ID NO: 20 is an amino acid sequence encoding a second polypeptide variant having the following amino acid substitutions, as compared to wild type second polypeptide: A1Q, C6S, C12S, C15S, P24S, and M38Y;

SEQ ID NO: 21 is a nucleotide sequence encoding a second polypeptide variant of SEQ ID NO: 22;

SEQ ID NO: 22 is an amino acid sequence encoding a second polypeptide variant having the following amino acid substitutions, as compared to wild type second polypeptide: A1Q, C6S, C12S, C15S, P24S, M38Y, and S40T.

SEQ ID NO: 23 is a nucleotide sequence encoding a second polypeptide variant of SEQ ID NO: 24;

SEQ ID NO: 24 is an amino acid sequence encoding a second polypeptide variant having the following amino acid substitutions, as compared to wild type second polypeptide: A1Q, C6S, C12S, C15S, P24S, M38Y, S40T, and T42E.

SEQ ID NO: 25 is a nucleotide sequence encoding a wild type butyrylcholinesterase (BChE) polypeptide of SEQ ID NO: 26;

SEQ ID NO: 26 is an amino acid sequence encoding a wild type BChE polypeptide;

SEQ ID NO: 27 is a nucleotide sequence encoding a BChE polypeptide variant of SEQ ID NO: 28;

SEQ ID NO: 28 is an amino acid sequence encoding a BChE polypeptide variant having the following amino acid substitutions, as compared to wild type BChE: A199S, A328W, and Y332G;

SEQ ID NO: 29 is a nucleotide sequence encoding a BChE polypeptide variant and fragment of SEQ ID NO: 30;

SEQ ID NO: 30 is an amino acid sequence encoding a BChE polypeptide variant and fragment having amino acids 1-531 and the following amino acid substitutions, as compared to wild type BChE: A199S, A328W, and Y332G;

SEQ ID NO: 31 is a nucleotide sequence encoding a BChE polypeptide variant and fragment of SEQ ID NO: 32;

SEQ ID NO: 32 is an amino acid sequence encoding a BChE polypeptide variant and fragment having amino acids 1-529 and the following amino acid substitutions, as compared to wild type BChE: A199S, A328W, and Y332G;

SEQ ID NO: 33 is a nucleotide sequence encoding a BChE polypeptide variant of SEQ ID NO: 34;

SEQ ID NO: 34 is an amino acid sequence encoding a BChE polypeptide variant having the following amino acid substitutions, as compared to wild type BChE: A199S, F227A, A328W, and Y332G;

SEQ ID NO: 35 is a nucleotide sequence encoding a BChE polypeptide variant and fragment of SEQ ID NO: 36;

SEQ ID NO: 36 is an amino acid sequence encoding a BChE polypeptide variant and fragment having amino acids 1-531 and the following amino acid substitutions, as compared to wild type BChE: A199S, F227A, A328W, and Y332G;

SEQ ID NO: 37 is a nucleotide sequence encoding a BChE polypeptide variant and fragment of SEQ ID NO: 38;

SEQ ID NO: 38 is an amino acid sequence encoding a BChE polypeptide variant and fragment having amino acids 1-529 and the following amino acid substitutions, as compared to wild type BChE: A199S, F227A, A328W, and Y332G;

SEQ ID NO: 39 is a nucleotide sequence encoding a BChE polypeptide variant of SEQ ID NO: 40;

SEQ ID NO: 40 is an amino acid sequence encoding a BChE polypeptide variant having the following amino acid substitutions, as compared to wild type BChE: A199S, S287G, A328W, and Y332G;

SEQ ID NO: 41 is a nucleotide sequence encoding a BChE polypeptide variant and fragment of SEQ ID NO: 42;

SEQ ID NO: 42 is an amino acid sequence encoding a BChE polypeptide variant and fragment having amino acids 1-531 and the following amino acid substitutions, as compared to wild type BChE: A199S, S287G, A328W, and Y332G;

SEQ ID NO: 43 is a nucleotide sequence encoding a BChE polypeptide variant and fragment of SEQ ID NO: 44;

SEQ ID NO: 44 is an amino acid sequence encoding a BChE polypeptide variant and fragment having amino acids 1-529 and the following amino acid substitutions, as compared to wild type BChE: A199S, S287G, A328W, and Y332G;

SEQ ID NO: 45 is a nucleotide sequence encoding a BChE polypeptide variant of SEQ ID NO: 46;

SEQ ID NO: 46 is an amino acid sequence encoding a BChE polypeptide variant having the following amino acid substitutions, as compared to wild type BChE: A199S, F227A, S287G, A328W, and Y332G;

SEQ ID NO: 47 is a nucleotide sequence encoding a BChE polypeptide variant and fragment of SEQ ID NO: 48;

SEQ ID NO: 48 is an amino acid sequence encoding a BChE polypeptide variant and fragment having amino acids 1-531 and the following amino acid substitutions, as compared to wild type BChE: A199S, F227A, S287G, A328W, and Y332G;

SEQ ID NO: 49 is a nucleotide sequence encoding a BChE polypeptide variant and fragment of SEQ ID NO: 50;

SEQ ID NO: 50 is an amino acid sequence encoding a BChE polypeptide variant and fragment having amino acids 1-529 and the following amino acid substitutions, as compared to wild type BChE: A199S, F227A, S287G, A328W, and Y332G;

SEQ ID NO: 51 is a nucleotide sequence encoding a BChE polypeptide variant of SEQ ID NO: 52;

SEQ ID NO: 52 is an amino acid sequence encoding a BChE polypeptide variant having the following amino acid substitutions, as compared to wild type BChE: A199S, F227A, S287G, A328W, and E441D;

SEQ ID NO: 53 is a nucleotide sequence encoding a BChE polypeptide variant and fragment of SEQ ID NO: 54;

SEQ ID NO: 54 is an amino acid sequence encoding a BChE polypeptide variant and fragment having amino acids 1-531 and the following amino acid substitutions, as compared to wild type BChE: A199S, F227A, S287G, A328W, and E441D;

SEQ ID NO: 55 is a nucleotide sequence encoding a BChE polypeptide variant and fragment of SEQ ID NO: 56;

SEQ ID NO: 56 is an amino acid sequence encoding a BChE polypeptide variant and fragment having amino acids 1-529 and the following amino acid substitutions, as compared to wild type BChE: A199S, F227A, S287G, A328W, and E441D;

SEQ ID NO: 57 is a nucleotide sequence encoding a BChE polypeptide variant of SEQ ID NO: 58;

SEQ ID NO: 58 is an amino acid sequence encoding a BChE polypeptide variant having the following amino acid substitutions, as compared to wild type BChE: A199S, F227A, P285A, S287G, A328W, and Y332G;

SEQ ID NO: 59 is a nucleotide sequence encoding a BChE polypeptide variant of SEQ ID NO: 60;

SEQ ID NO: 60 is an amino acid sequence encoding a BChE polypeptide variant having the following amino acid substitutions, as compared to wild type BChE: A199S, F227A, P285S, S287G, A328W, and Y332G;

SEQ ID NO: 61 is a nucleotide sequence encoding a BChE polypeptide variant of SEQ ID NO: 62;

SEQ ID NO: 62 is an amino acid sequence encoding a BChE polypeptide variant having the following amino acid substitutions, as compared to wild type BChE: A199S, F227A, P285Q, S287G, A328W, and Y332G;

SEQ ID NO: 63 is a nucleotide sequence encoding a BChE polypeptide variant of SEQ ID NO: 64;

SEQ ID NO: 64 is an amino acid sequence encoding a BChE polypeptide variant having the following amino acid substitutions, as compared to wild type BChE: A199S, F227P, S287G, A328W, and Y332G;

SEQ ID NO: 65 is a nucleotide sequence encoding a BChE polypeptide variant of SEQ ID NO: 66;

SEQ ID NO: 66 is an amino acid sequence encoding a BChE polypeptide variant having the following amino acid substitutions, as compared to wild type BChE: A199S, F227A, P285G, S287G, A328W, and Y332G;

SEQ ID NO: 67 is a nucleotide sequence encoding a BChE polypeptide variant of SEQ ID NO: 68;

SEQ ID NO: 68 is an amino acid sequence encoding a BChE polypeptide variant having the following amino acid substitutions, as compared to wild type BChE: A199S, F227A, L286M, S287G, A328W, and Y332G;

SEQ ID NO: 69 is a nucleotide sequence encoding a BChE polypeptide variant of SEQ ID NO: 70;

SEQ ID NO: 70 is an amino acid sequence encoding a BChE polypeptide variant having the following amino acid substitutions, as compared to wild type BChE: A199S, P285Q, S287G, A328W, and Y332G;

SEQ ID NO: 71 is a nucleotide sequence encoding a BChE polypeptide variant of SEQ ID NO: 72;

SEQ ID NO: 72 is an amino acid sequence encoding a BChE polypeptide variant having the following amino acid substitutions, as compared to wild type BChE: A199S, P285I, S287G, A328W, and Y332G;

SEQ ID NO: 73 is a nucleotide sequence encoding a BChE polypeptide variant of SEQ ID NO: 74;

SEQ ID NO: 74 is an amino acid sequence encoding a BChE polypeptide variant having the following amino acid substitutions, as compared to wild type BChE: A199S, F227G, S287G, A328W, and Y332G;

SEQ ID NO: 75 is a nucleotide sequence encoding a BChE polypeptide variant of SEQ ID NO: 76;

SEQ ID NO: 76 is an amino acid sequence encoding a BChE polypeptide variant having the following amino acid substitutions, as compared to wild type BChE: A199S, P285S, S287G, A328W, and Y332G;

SEQ ID NO: 77 is a nucleotide sequence encoding a BChE polypeptide variant of SEQ ID NO: 78;

SEQ ID NO: 78 is an amino acid sequence encoding a BChE polypeptide variant having the following amino acid substitutions, as compared to wild type BChE: A199S, F227V, S287G, A328W, and Y332G;

SEQ ID NO: 79 is a nucleotide sequence encoding a BChE polypeptide variant of SEQ ID NO: 80;

SEQ ID NO: 80 is an amino acid sequence encoding a BChE polypeptide variant having the following amino acid substitutions, as compared to wild type BChE: A199S, P285G, S287G, A328W, and Y332G;

SEQ ID NO: 81 is a nucleotide sequence encoding a BChE polypeptide variant of SEQ ID NO: 82;

SEQ ID NO: 82 is an amino acid sequence encoding a BChE polypeptide variant having the following amino acid substitutions, as compared to wild type BChE: A199S, F227I, S287G, A328W, and Y332G;

SEQ ID NO: 83 is a nucleotide sequence encoding a BChE polypeptide variant of SEQ ID NO: 84;

SEQ ID NO: 84 is an amino acid sequence encoding a BChE polypeptide variant having the following amino acid substitutions, as compared to wild type BChE: A199S, F227L, S287G, A328W, and Y332G;

SEQ ID NO: 85 is a nucleotide sequence encoding a BChE polypeptide variant of SEQ ID NO: 86;

SEQ ID NO: 86 is an amino acid sequence encoding a BChE polypeptide variant having the following amino acid substitutions, as compared to wild type BChE: A199S, L286M, S287G, A328W, and Y332G;

SEQ ID NO: 87 is a nucleotide sequence encoding a BChE polypeptide variant of SEQ ID NO: 88;

SEQ ID NO: 88 is an amino acid sequence encoding a BChE polypeptide variant having the following amino acid substitutions, as compared to wild type BChE: A199S, F227A, P285K, S287G, A328W, and Y332G;

SEQ ID NO: 89 is a nucleotide sequence encoding a BChE polypeptide variant of SEQ ID NO: 90;

SEQ ID NO: 90 is an amino acid sequence encoding a BChE polypeptide variant having the following amino acid substitutions, as compared to wild type BChE: A199S, F227S, S287G, A328W, and Y332G;

SEQ ID NO: 91 is a nucleotide sequence encoding a BChE polypeptide variant of SEQ ID NO: 92;

SEQ ID NO: 92 is an amino acid sequence encoding a BChE polypeptide variant having the following amino acid substitutions, as compared to wild type BChE: A199S, F227T, S287G, A328W, and Y332G;

SEQ ID NO: 93 is a nucleotide sequence encoding a BChE polypeptide variant of SEQ ID NO: 94;

SEQ ID NO: 94 is an amino acid sequence encoding a BChE polypeptide variant having the following amino acid substitutions, as compared to wild type BChE: A199S, F227M, S287G, A328W, and Y332G;

SEQ ID NO: 95 is a nucleotide sequence encoding a BChE polypeptide variant of SEQ ID NO: 96;

SEQ ID NO: 96 is an amino acid sequence encoding a BChE polypeptide variant having the following amino acid substitutions, as compared to wild type BChE: A199S, F227C, S287G, A328W, and Y332G;

SEQ ID NO: 97 is a nucleotide sequence encoding a BChE polypeptide variant of SEQ ID NO: 98;

SEQ ID NO: 98 is an amino acid sequence encoding a BChE polypeptide variant having the following amino acid substitutions, as compared to wild type BChE: A199S, F227A, P285N, S287G, A328W, and Y332G;

SEQ ID NO: 99 is a nucleotide sequence encoding a BChE polypeptide variant of SEQ ID NO: 100;

SEQ ID NO: 100 is an amino acid sequence encoding a BChE polypeptide variant having the following amino acid substitutions, as compared to wild type BChE: A199S, F227P, P285A, S287G, A328W, and Y332G;

SEQ ID NO: 101 is a nucleotide sequence encoding a BChE polypeptide variant of SEQ ID NO: 102;

SEQ ID NO: 102 is an amino acid sequence encoding a BChE polypeptide variant having the following amino acid substitutions, as compared to wild type BChE: A199S, F227S, P285Q, S287G, A328W, and Y332G;

SEQ ID NO: 103 is a nucleotide sequence encoding a BChE polypeptide variant of SEQ ID NO: 104;

SEQ ID NO: 104 is an amino acid sequence encoding a BChE polypeptide variant having the following amino acid substitutions, as compared to wild type BChE: A199S, F227S, P285S, S287G, A328W, and Y332G;

SEQ ID NO: 105 is a nucleotide sequence encoding a BChE polypeptide variant of SEQ ID NO: 106;

SEQ ID NO: 106 is an amino acid sequence encoding a BChE polypeptide variant having the following amino acid substitutions, as compared to wild type BChE: A199S, F227S, P285G, S287G, A328W, and Y332G;

SEQ ID NO: 107 is a nucleotide sequence encoding a BChE polypeptide variant of SEQ ID NO: 108;

SEQ ID NO: 108 is an amino acid sequence encoding a BChE polypeptide variant having the following amino acid substitutions, as compared to wild type BChE: A199S, F227P, P285S, L286M, S287G, A328W, and Y332G;

SEQ ID NO: 109 is a nucleotide sequence encoding a BChE polypeptide variant of SEQ ID NO: 110;

SEQ ID NO: 110 is an amino acid sequence encoding a BChE polypeptide variant having the following amino acid substitutions, as compared to wild type BChE: A199S, F227A, P285S, S287G, A328W, and E441D;

SEQ ID NO: 111 is a nucleotide sequence encoding a BChE polypeptide variant of SEQ ID NO: 112;

SEQ ID NO: 112 is an amino acid sequence encoding a BChE polypeptide variant having the following amino acid substitutions, as compared to wild type BChE: A199S, F227A, P285A, S287G, A328W, and E441D;

SEQ ID NO: 113 is a nucleotide sequence encoding a BChE polypeptide variant of SEQ ID NO: 114;

SEQ ID NO: 114 is an amino acid sequence encoding a BChE polypeptide variant having the following amino acid substitutions, as compared to wild type BChE: A199S, F227P, L286M, S287G, A328W, and Y332G;

SEQ ID NO: 115 is a nucleotide sequence encoding a BChE polypeptide variant of SEQ ID NO: 116;

SEQ ID NO: 116 is an amino acid sequence encoding a BChE polypeptide variant having the following amino acid substitutions, as compared to wild type BChE: A199S, F227G, P285A, S287G, A328W, and Y332G;

SEQ ID NO: 117 is a nucleotide sequence encoding a BChE polypeptide variant of SEQ ID NO: 118;

SEQ ID NO: 118 is an amino acid sequence encoding a BChE polypeptide variant having the following amino acid substitutions, as compared to wild type BChE: A199S, F227G, P285G, S287G, A328W, and Y332G;

SEQ ID NO: 119 is a nucleotide sequence encoding a BChE polypeptide variant of SEQ ID NO: 120;

SEQ ID NO: 120 is an amino acid sequence encoding a BChE polypeptide variant having the following amino acid substitutions, as compared to wild type BChE: A199S, F227G, P285Q, S287G, A328W, and Y332G;

SEQ ID NO: 121 is a nucleotide sequence encoding a BChE polypeptide variant of SEQ ID NO: 122;

SEQ ID NO: 122 is an amino acid sequence encoding a BChE polypeptide variant having the following amino acid substitutions, as compared to wild type BChE: A199S, F227G, P285S, S287G, A328W, and Y332G;

SEQ ID NO: 123 is a nucleotide sequence encoding a BChE polypeptide variant of SEQ ID NO: 124;

SEQ ID NO: 124 is an amino acid sequence encoding a BChE polypeptide variant having the following amino acid substitutions, as compared to wild type BChE: A199S, F227A, P285E, S287G, A328W, and Y332G;

SEQ ID NO: 125 is a nucleotide sequence encoding a BChE polypeptide variant of SEQ ID NO: 126;

SEQ ID NO: 126 is an amino acid sequence encoding a BChE polypeptide variant having the following amino acid substitutions, as compared to wild type BChE: A199S, F227P, P285N, S287G, A328W, and Y332G;

SEQ ID NO: 127 is a nucleotide sequence encoding a BChE polypeptide variant of SEQ ID NO: 128;

SEQ ID NO: 128 is an amino acid sequence encoding a BChE polypeptide variant having the following amino acid substitutions, as compared to wild type BChE: A199S, F227S, P285A, S287G, A328W, and Y332G;

SEQ ID NO: 129 is a nucleotide sequence encoding a BChE polypeptide variant of SEQ ID NO: 130;

SEQ ID NO: 130 is an amino acid sequence encoding a BChE polypeptide variant having the following amino acid substitutions, as compared to wild type BChE: A199S, F227S, P285N, S287G, A328W, and Y332G;

SEQ ID NO: 131 is a nucleotide sequence encoding a BChE polypeptide variant of SEQ ID NO: 132;

SEQ ID NO: 132 is an amino acid sequence encoding a BChE polypeptide variant having the following amino acid substitutions, as compared to wild type BChE: A199S, F227S, L286M, S287G, A328W, and Y332G;

SEQ ID NO: 133 is a nucleotide sequence encoding a BChE polypeptide variant of SEQ ID NO: 134;

SEQ ID NO: 134 is an amino acid sequence encoding a BChE polypeptide variant having the following amino acid substitutions, as compared to wild type BChE: A199S, F227G, L286M, S287G, A328W, and Y332G.

SEQ ID NO: 135 is an amino acid sequence encoding a BChE polypeptide variant and fragment having amino acids 1-530 and the following amino acid substitutions, as compared to wild type BChE: A199S, F227A, S287G, A328W, and Y332G;

SEQ ID NO: 136 is an amino acid sequence encoding a BChE polypeptide variant and fragment having amino acids 1-532 and the following amino acid substitutions, as compared to wild type BChE: A199S, F227A, S287G, A328W, and Y332G;

SEQ ID NO: 137 is an amino acid sequence encoding a BChE polypeptide variant and fragment having amino acids 1-533 and the following amino acid substitutions, as compared to wild type BChE: A199S, F227A, S287G, A328W, and Y332G;

SEQ ID NO: 138 is an amino acid sequence encoding a BChE polypeptide variant and fragment having amino acids 1-534 and the following amino acid substitutions, as compared to wild type BChE: A199S, F227A, S287G, A328W, and Y332G;

SEQ ID NO: 139 is an amino acid sequence encoding a BChE polypeptide variant and fragment having amino acids 1-535 and the following amino acid substitutions, as compared to wild type BChE: A199S, F227A, S287G, A328W, and Y332G;

SEQ ID NO: 140 is an amino acid sequence encoding a BChE polypeptide variant and fragment having amino acids 1-536 and the following amino acid substitutions, as compared to wild type BChE: A199S, F227A, S287G, A328W, and Y332G;

SEQ ID NO: 141 is an amino acid sequence encoding a BChE polypeptide variant and fragment having amino acids 1-537 and the following amino acid substitutions, as compared to wild type BChE: A199S, F227A, S287G, A328W, and Y332G;

SEQ ID NO: 142 is an amino acid sequence encoding a BChE polypeptide variant and fragment having amino acids 1-538 and the following amino acid substitutions, as compared to wild type BChE: A199S, F227A, S287G, A328W, and Y332G;

SEQ ID NO: 143 is an amino acid sequence encoding a BChE polypeptide variant and fragment having amino acids 1-539 and the following amino acid substitutions, as compared to wild type BChE: A199S, F227A, S287G, A328W, and Y332G;

SEQ ID NO: 144 is an amino acid sequence encoding a BChE polypeptide variant and fragment having amino acids 1-540 and the following amino acid substitutions, as compared to wild type BChE: A199S, F227A, S287G, A328W, and Y332G;

SEQ ID NO: 145 is an amino acid sequence encoding a BChE polypeptide variant and fragment having amino acids 1-529 and the following amino acid substitutions, as compared to wild type BChE: A199S, F227A, P285Q, S287G, A328W, and Y332G;

SEQ ID NO: 146 is an amino acid sequence encoding a BChE polypeptide variant and fragment having amino acids 1-536 and the following amino acid substitutions, as compared to wild type BChE: A199S, F227A, P285Q, S287G, A328W, and Y332G;

SEQ ID NO: 147 is an amino acid sequence encoding a polypeptide comprising a BChE polypeptide of SEQ ID NO: 50, a linker having the amino acid sequence GGGGGGS, and a second polypeptide sequence of SEQ ID NO: 4;

SEQ ID NO: 148 is an amino acid sequence encoding a polypeptide comprising a BChE polypeptide of SEQ ID NO: 50 and a second polypeptide sequence of SEQ ID NO: 2;

SEQ ID NO: 149 is an amino acid sequence encoding a polypeptide comprising a BChE polypeptide of SEQ ID NO: 46, a linker having the amino acid sequence GGGGGGS, and a second polypeptide sequence of SEQ ID NO: 6;

SEQ ID NO: 150 is an amino acid sequence encoding a polypeptide comprising a BChE polypeptide of SEQ ID NO: 46 and a second polypeptide sequence of SEQ ID NO: 6;

SEQ ID NO: 151 is an amino acid sequence encoding a polypeptide comprising a BChE polypeptide of SEQ ID NO: 50, a linker having the amino acid sequence GGGGGGS, and a second polypeptide sequence of SEQ ID NO: 6;

SEQ ID NO: 152 is an amino acid sequence encoding a polypeptide comprising a BChE polypeptide of SEQ ID NO: 50 and a second polypeptide sequence of SEQ ID NO: 6;

SEQ ID NO: 153 is an amino acid sequence encoding a polypeptide comprising a BChE polypeptide of SEQ ID NO: 50 and a second polypeptide sequence of SEQ ID NO: 8;

SEQ ID NO: 154 is an amino acid sequence encoding a polypeptide comprising a BChE polypeptide of SEQ ID NO: 50 and a second polypeptide sequence of SEQ ID NO: 10;

SEQ ID NO: 155 is an amino acid sequence encoding a polypeptide comprising a BChE polypeptide of SEQ ID NO: 135 and a second polypeptide sequence of SEQ ID NO: 6;

SEQ ID NO: 156 is an amino acid sequence encoding a polypeptide comprising a BChE polypeptide of SEQ ID NO: 46 and a second polypeptide sequence of SEQ ID NO: 6;

SEQ ID NO: 157 is an amino acid sequence encoding a polypeptide comprising a BChE polypeptide of SEQ ID NO: 136 and a second polypeptide sequence of SEQ ID NO: 6;

SEQ ID NO: 158 is an amino acid sequence encoding a polypeptide comprising a BChE polypeptide of SEQ ID NO: 137 and a second polypeptide sequence of SEQ ID NO: 6;

SEQ ID NO: 159 is an amino acid sequence encoding a polypeptide comprising a BChE polypeptide of SEQ ID NO: 138 and a second polypeptide sequence of SEQ ID NO: 6;

SEQ ID NO: 160 is an amino acid sequence encoding a polypeptide comprising a BChE polypeptide of SEQ ID NO: 139 and a second polypeptide sequence of SEQ ID NO: 6;

SEQ ID NO: 161 is an amino acid sequence encoding a polypeptide comprising a BChE polypeptide of SEQ ID NO: 140 and a second polypeptide sequence of SEQ ID NO: 6;

SEQ ID NO: 162 is an amino acid sequence encoding a polypeptide comprising a BChE polypeptide of SEQ ID NO: 141 and a second polypeptide sequence of SEQ ID NO: 6;

SEQ ID NO: 163 is an amino acid sequence encoding a polypeptide comprising a BChE polypeptide of SEQ ID NO: 142 and a second polypeptide sequence of SEQ ID NO: 6;

SEQ ID NO: 164 is an amino acid sequence encoding a polypeptide comprising a BChE polypeptide of SEQ ID NO: 143 and a second polypeptide sequence of SEQ ID NO: 6;

SEQ ID NO: 165 is an amino acid sequence encoding a polypeptide comprising a BChE polypeptide of SEQ ID NO: 144 and a second polypeptide sequence of SEQ ID NO: 6;

SEQ ID NO: 166 is an amino acid sequence encoding a polypeptide comprising a BChE polypeptide of SEQ ID NO: 50 and a second polypeptide sequence of SEQ ID NO: 12;

SEQ ID NO: 167 is an amino acid sequence encoding a polypeptide comprising a BChE polypeptide of SEQ ID NO: 50 and a second polypeptide sequence of SEQ ID NO: 14;

SEQ ID NO: 168 is an amino acid sequence encoding a polypeptide comprising a BChE polypeptide of SEQ ID NO: 50 and a second polypeptide sequence of SEQ ID NO: 16;

SEQ ID NO: 169 is an amino acid sequence encoding a polypeptide comprising a BChE polypeptide of SEQ ID NO: 50 and a second polypeptide sequence of SEQ ID NO: 18;

SEQ ID NO: 170 is an amino acid sequence encoding a polypeptide comprising a BChE polypeptide of SEQ ID NO: 137 and a second polypeptide sequence of SEQ ID NO: 18;

SEQ ID NO: 171 is an amino acid sequence encoding a polypeptide comprising a BChE polypeptide of SEQ ID NO: 140 and a second polypeptide sequence of SEQ ID NO: 18;

SEQ ID NO: 172 is an amino acid sequence encoding a polypeptide comprising a BChE polypeptide of SEQ ID NO: 50 and a second polypeptide sequence of SEQ ID NO: 20;

SEQ ID NO: 173 is an amino acid sequence encoding a polypeptide comprising a BChE polypeptide of SEQ ID NO: 50 and a second polypeptide sequence of SEQ ID NO: 22;

SEQ ID NO: 174 is an amino acid sequence encoding a polypeptide comprising a BChE polypeptide of SEQ ID NO: 50 and a second polypeptide sequence of SEQ ID NO: 24;

SEQ ID NO: 175 is an amino acid sequence encoding a polypeptide comprising a BChE polypeptide of SEQ ID NO: 137 and a second polypeptide sequence of SEQ ID NO: 24;

SEQ ID NO: 176 is an amino acid sequence encoding a polypeptide comprising a BChE polypeptide of SEQ ID NO: 140 and a second polypeptide sequence of SEQ ID NO: 24;

SEQ ID NO: 177 is an amino acid sequence encoding a polypeptide comprising a BChE polypeptide of SEQ ID NO: 145 and a second polypeptide sequence of SEQ ID NO: 6; and SEQ ID NO: 178 is an amino acid sequence encoding a polypeptide comprising a BChE polypeptide of SEQ ID NO: 146 and a second polypeptide sequence of SEQ ID NO: 18.

SEQ ID NO: 179 is an amino acid sequence encoding a polypeptide comprising a BChE polypeptide of SEQ ID NO:62 and a second polypeptide sequence of SEQ ID NO: 12.

SEQ ID NO: 180 is an amino acid sequence encoding a polypeptide comprising a BChE polypeptide of SEQ ID NO:62 and a second polypeptide sequence of SEQ ID NO: 18.

SEQ ID NO: 181 is an amino acid sequence encoding a polypeptide comprising a BChE polypeptide of SEQ ID NO:58 and a second polypeptide sequence of SEQ ID NO: 12.

SEQ ID NO: 182 is an amino acid sequence encoding a polypeptide comprising a BChE polypeptide of SEQ ID NO:58 and a second polypeptide sequence of SEQ ID NO: 18.

DESCRIPTION OF EXEMPLARY EMBODIMENTS

The details of one or more embodiments of the presently-disclosed subject matter are set forth in this document. Modifications to embodiments described in this document, and other embodiments, will be evident to those of ordinary skill in the art after a study of the information provided in this document. The information provided in this document, and particularly the specific details of the described exemplary embodiments, is provided primarily for clearness of understanding and no unnecessary limitations are to be understood therefrom. In case of conflict, the specification of this document, including definitions, will control.

The presently-disclosed subject matter includes an isolated polypeptide that comprises a butyrylcholinesterase (BChE) polypeptide, or variants and/or fragments thereof, and a second polypeptide, or variants and/or fragments thereof. The isolated polypeptides disclosed herein have enhanced catalytic efficiency for (−)-cocaine, as compared to wild type BChE. Furthermore, the isolated polypeptides comprising BChE, or variants and/or fragments thereof, disclosed herein can also have a longer half-life in blood than BChE polypeptides alone. Exemplary BChE polypeptides, including fragments and/or variants thereof, include those shown in U.S. Pat. Nos. 8,592,193, 8,206,703, 8,193, 327, 7,919,082, 7,892,537, 7,740,840, 7,731,957, and 7,438, 904, all of which are incorporated herein by this reference in their entirety.

The presently-disclosed subject matter further includes a pharmaceutical composition including an isolated polypeptide, as described herein, and a suitable pharmaceutical carrier. The presently-disclosed subject matter further includes a method for treating a cocaine-induced condition in a subject comprising administering to an individual an effective amount of an isolated polypeptide and/or an isolated nucleotide (i.e., a nucleotide molecule encoding an isolated polypeptide, as disclosed herein) to lower blood cocaine concentration in the subject. A cocaine-induced condition resulting from the administration and/or use of cocaine, including, for example, overdose and treatment for an addiction to cocaine. For example, a polypeptide or nucleotide, as described herein, could be administered prior to the use of cocaine as part of an addiction treatment strategy (e.g., rehabilitation).

The term "isolated", when used in the context of an isolated nucleotide or an isolated polypeptide, is a nucleotide or polypeptide that, by the hand of man, exists apart from its native environment and is therefore not a product of nature. An isolated nucleotide or polypeptide can exist in a purified form or can exist in a non-native environment such as, for example, in a transgenic host cell.

In some embodiments, the isolated polypeptide comprises a BChE polypeptide variant and/or fragment. For example, a BChE polypeptide variant can comprise a wild type BChE polypeptide having one to ten or more amino acid substitutions selected from A199S, F227A, F227C, F227G, F227I, F227L, F227M, F227P, F227S, F227T, F227V, P285A, P285E, P285G, P285I, P285K, P285N, P285Q, P285S, L286M, S287G, A328W, Y332G, and E441D. In some embodiments, the particular BChE polypeptide variants exhibit increased catalytic efficiency against (−)-cocaine compared to wild type BChE polypeptides.

The terms "polypeptide", "protein", and "peptide", which are used interchangeably herein, refer to a polymer of the protein amino acids, or amino acid analogs, regardless of its size or function. Although "protein" is often used in reference to relatively large polypeptides, and "peptide" is often used in reference to small polypeptides, usage of these terms in the art overlaps and varies. The term "polypeptide" as used herein refers to peptides, polypeptides, and proteins, unless otherwise noted. The terms "protein", "polypeptide", and "peptide" are used interchangeably herein when referring to a gene product. Thus, exemplary polypeptides include gene products, naturally occurring proteins, homologs, orthologs, paralogs, fragments and other equivalents, variants, and analogs of the foregoing. Furthermore, the term "fusion polypeptide" is used herein to generally refer to a polypeptide formed from two or more distinct polypeptides.

The term "variant" refers to an amino acid sequence that is different from the reference polypeptide by one or more amino acids, e.g., one or more amino acid substitutions. For example a butyrylcholinesterase (BChE) polypeptide variant differs from wild-type BChE (SEQ ID NO: 26) by one or more amino acid substitutions, i.e., mutations. An example of a BChE variant is shown as SEQ ID NO: 28. Another example of a BChE variant includes a sequence that 0 to about 41 amino acid residues are deleted from the N-terminus, and 0 to about 98 amino acid residues are deleted from the C-terminus of the wild-type BChE. Another example of a BChE variant includes one, two, three, four, five six, seven, or eight substitutions relative to wild-type BChE (SEQ ID NO: 26) at A199, F227, P285, L286, S287, A328, Y332, and/or E441, in particular, the variant comprises one to eight amino acid mutations relative to SEQ ID NO:26 selected from A199S, F227A, F227C, F227G, F227I, F227M, F227P, F227S, F227T, or F227V; P285A, P285E, P285G, P285I, P285K, P285N, P285Q, or P285S; L286M; S287G; A328W; Y332G, and E441D.

In some embodiments, the BChE polypeptide is a fragment of a wild type BChE polypeptide. In some embodiments the BChE polypeptide can comprise about 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 76, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, or 573 amino acid residues. In other words, some embodiments comprise a BChE polypeptide fragments having about 1 to about 139 amino acid residues deleted compared to the wild type BChE polypeptide. In some embodiments the BChE polypeptide fragment has amino acid residues deleted from the N-terminus of the polypeptide, the C-terminus of the polypeptide, or a combination thereof. In some embodiments the BChE polypeptide fragment comprises at least amino acids 42-476. In other embodiments the BChE polypeptide fragment comprises amino acids 1-529, 1-530, 1-531, 1-532, 1-533, 1-534, 1-135, or 1-536.

In this regard, the terms "polypeptide fragment" or "fragment", when used in reference to a reference polypeptide, refers to a polypeptide in which amino acid residues are deleted as compared to the reference polypeptide itself, but where the remaining amino acid sequence is usually identical to the corresponding positions in the reference polypeptide. As mentioned above, such deletions can occur at the amino-terminus of the reference polypeptide, the carboxy-terminus of the reference polypeptide, or both terminuses. A fragment can also be a "functional fragment," in which case the fragment retains some or all of the activity of the reference polypeptide as described herein. For example, in some embodiments a functional fragment of a particular BChE polypeptide variant can retain some or all of the cocaine hydrolysis activity, i.e., the catalytic efficiency for (−)-cocaine, of the particular BChE polypeptide variant. In this regard, the term "BChE polypeptide variant" is inclusive of functional fragments of the BChE polypeptide variant. The term "BChE polypeptide variant" is inclusive of functional fragments wherein one or more residues from 1 to 41 and/or one or more residues from 477 to 574 are truncated relative to the full-length BChE polypeptide variant. See Brimijoin, S. et al., *Neuropsychopharmacology* 2008, 33, 2715-2725.

In some embodiments, the isolated polypeptide comprises a second polypeptide variant and/or fragment thereof. For example, the 233 amino acid sequence shown as SEQ ID NO: 2 is the wild type second polypeptide, and this wild type polypeptide can have one or more amino acid substitutions selected from A1Q, A1V, C6S, C12S, C15S, P24S, T36Q, M38Y, M38W, M38F, I39A, 540T, T42D, T42E, T42Q, P43I, E58Q, E69Q, E80Q, T93Q, V94P, V94T, L95P, Q97I, Q97S, D98N, N101D, D142E, L144M, A164V, E166A, G171D, G171R, Q172T, Q172P, P173R, N175P, N175S, M214L, N220A, N220Y, N220H, N220F, Y222H, and Y222I. In some embodiments, the variant comprises one, two, three, four, five, six, seven, eight, nine or ten of these amino acid substitutions relative to SEQ ID NO: 2. In some embodiments, isolated polypeptides comprising second polypeptide variants exhibit an increased half-life over isolated polypeptides comprising a wild type second polypeptide.

In some embodiments, the second polypeptide is a fragment of a wild type second polypeptide. In some embodiments the second polypeptide can comprise at least about 217, 218, 219, 220, 221, 222, 223, 224, 225, 226, 227, 228, 229, 230, 231, or 232 amino acid residues. In other words, some embodiments comprise second polypeptides fragments having about 1 to about 16 amino acid residues deleted compared to the wild type second polypeptide. In some embodiments the second polypeptide fragment has amino acid residues deleted from the N-terminus of the polypeptide, the C-terminus of the polypeptide, or a combination thereof.

Embodiments of the isolated polypeptide can comprise a BChE polypeptide, or a variant and/or fragment thereof, and a second polypeptide, or a variant and/or fragment thereof, that are in any order relative to each other. Specifically, in some embodiments the isolated polypeptide comprises, from the N-terminus to the C-terminus, a BChE polypeptide and a second polypeptide. In other embodiments the isolated polypeptide comprises, from the N-terminus to the C-terminus, a second polypeptide and a BChE polypeptide.

Some embodiments of an isolated polypeptide further comprise a linker disposed between the BChE polypeptide and the second polypeptide. In some embodiments the linker comprises a sequence of about 1 to about 7 amino acid residues. In some embodiments the linker comprises one or more glycine residue in sequence with a terminal serine (e.g., GGGGGGS (SEQ ID NO: 4)).

Exemplary isolated polypeptides include those listed in Table 1 below.

TABLE 1

| BChE variant | BChE Polypeptide SEQ ID NO: | BChE Amino Acids | Linker | Second Polypeptide SEQ ID NO | Second Polypeptide Amino Acids | Isolated Polypeptide SEQ ID NO: | $t_{1/2}$ (h) in rats |
|---|---|---|---|---|---|---|---|
| A | SEQ ID NO 50 | 1-529 | GGGGGGS | SEQ ID NO: 4 | 17-233 | SEQ ID NO 147 | 24 |
| A | SEQ ID NO 50 | 1-529 | No Linker | SEQ ID NO 2 | 1-233 | SEQ ID NO 148 | 83 |
| A | SEQ ID NO 46 | 1-574 | GGGGGGS | SEQ ID NO 6 | 1-233 | SEQ ID NO 149 | 19 |
| A | SEQ ID NO 46 | 1-574 | No Linker | SEQ ID NO 6 | 1-233 | SEQ ID NO 150 | 24 |
| A | SEQ ID NO 50 | 1-529 | GGGGGGS | SEQ ID NO 6 | 1-233 | SEQ ID NO 151 | 48 |
| A | SEQ ID NO 50 | 1-529 | No Linker | SEQ ID NO 6 | 1-233 | SEQ ID NO 152 | 110 |
| A | SEQ ID NO 50 | 1-529 | No Linker | SEQ ID NO 8 | 1-233 | SEQ ID NO 153 | 85 |
| A | SEQ ID NO 50 | 1-529 | No Linker | SEQ ID NO 10 | 1-233 | SEQ ID NO 154 | 82 |
| A | SEQ ID NO 135 | 1-530 | No Linker | SEQ ID NO 6 | 1-233 | SEQ ID NO 155 | 131 |
| A | SEQ ID NO 48 | 1-531 | No Linker | SEQ ID NO 6 | 1-233 | SEQ ID NO 156 | 27 |
| A | SEQ ID NO 136 | 1-532 | No Linker | SEQ ID NO 6 | 1-233 | SEQ ID NO 157 | 93 |
| A | SEQ ID NO 137 | 1-533 | No Linker | SEQ ID NO 6 | 1-233 | SEQ ID NO 158 | 146 |
| A | SEQ ID NO 138 | 1-534 | No Linker | SEQ ID NO 6 | 1-233 | SEQ ID NO 159 | 115 |
| A | SEQ ID NO 139 | 1-535 | No Linker | SEQ ID NO 6 | 1-233 | SEQ ID NO 160 | 157 |
| A | SEQ ID NO 140 | 1-536 | No Linker | SEQ ID NO 6 | 1-233 | SEQ ID NO 161 | 141 |
| A | SEQ ID NO 141 | 1-537 | No Linker | SEQ ID NO 6 | 1-233 | SEQ ID NO 162 | 122 |
| A | SEQ ID NO 142 | 1-538 | No Linker | SEQ ID NO 6 | 1-233 | SEQ ID NO 163 | 106 |
| A | SEQ ID NO 143 | 1-539 | No Linker | SEQ ID NO 6 | 1-233 | SEQ ID NO 164 | 100 |
| A | SEQ ID NO 144 | 1-540 | No Linker | SEQ ID NO 6 | 1-233 | SEQ ID NO 165 | 121 |
| A | SEQ ID NO 50 | 1-529 | No Linker | SEQ ID NO 12 | 1-233 | SEQ ID NO 166 | 174 |
| A | SEQ ID NO 50 | 1-529 | No Linker | SEQ ID NO 14 | 1-233 | SEQ ID NO 167 | 143 |

TABLE 1-continued

| BChE variant | BChE Polypeptide SEQ ID NO: | BChE Amino Acids | Linker | Second Polypeptide SEQ ID NO | Second Polypeptide Amino Acids | Isolated Polypeptide SEQ ID NO: | $t_{1/2}$ (h) in rats |
|---|---|---|---|---|---|---|---|
| A | SEQ ID NO 50 | 1-529 | No Linker | SEQ ID NO 16 | 1-233 | SEQ ID NO 168 | 154 |
| A | SEQ ID NO 50 | 1-529 | No Linker | SEQ ID NO 18 | 1-233 | SEQ ID NO 169 | 200 |
| A | SEQ ID NO 137 | 1-533 | No Linker | SEQ ID NO 18 | 1-233 | SEQ ID NO 170 | 140 |
| A | SEQ ID NO 140 | 1-536 | No Linker | SEQ ID NO 18 | 1-233 | SEQ ID NO 171 | 108 |
| A | SEQ ID NO 50 | 1-529 | No Linker | SEQ ID NO 20 | 1-233 | SEQ ID NO 172 | 112 |
| A | SEQ ID NO 50 | 1-529 | No Linker | SEQ ID NO 22 | 1-233 | SEQ ID NO 173 | 100 |
| A | SEQ ID NO 50 | 1-529 | No Linker | SEQ ID NO 24 | 1-233 | SEQ ID NO 174 | 100 |
| A | SEQ ID NO 137 | 1-533 | No Linker | SEQ ID NO 24 | 1-233 | SEQ ID NO 175 | 96 |
| A | SEQ ID NO 140 | 1-536 | No Linker | SEQ ID NO 24 | 1-233 | SEQ ID NO 176 | 79 |
| B | SEQ ID NO 145 | 1-529 | No Linker | SEQ ID NO 6 | 1-233 | SEQ ID NO 177 | 107 |
| B | SEQ ID NO 146 | 1-536 | No Linker | SEQ ID NO 18 | 1-233 | SEQ ID NO 178 | 148 |
| B | SEQ ID NO 62 | 1-529 | No Linker | SEQ ID NO 12 | 1-233 | SEQ ID NO 179 | |
| B | SEQ ID NO 62 | 1-529 | No Linker | SEQ ID NO 18 | 1-233 | SEQ ID NO 180 | |
| C | SEQ ID NO 58 | 1-529 | No Linker | SEQ ID NO 12 | 1-233 | SEQ ID NO 181 | |
| C | SEQ ID NO 58 | 1-529 | No Linker | SEQ ID NO 18 | 1-233 | SEQ ID NO 182 | |

A represents the A199S/F227A/S287G/A328W/Y332G variant.
B refers to the A199S/F227A/P285Q/S287G/A328W/Y332G variant.
C refers to the A199S/F227A/P285A/S287G/A328W/Y332G variant.

The presently-disclosed subject matter also includes nucleic acid molecules that encode an isolated polypeptide. In some embodiments the nucleic acid molecule comprises a nucleic acid molecule encoding a BChE polypeptide variant and/or fragment (e.g., SEQ ID NOS: 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, or 133). Alternatively or additionally, in some embodiments the nucleic acid molecule comprises a nucleic acid molecule encoding a second polypeptide variant and/or fragment (e.g., SEQ ID NOS: 5, 7, 9, 11, 13, 15, 17, 19, 21, 23).

The terms "nucleotide," "polynucleotide," "nucleic acid," and "nucleic acid sequence" refer to deoxyribonucleotides or ribonucleotides and polymers thereof in either single or double stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified versions thereof (e.g., degenerate codon substitutions) and complementary sequences and as well as the sequence explicitly indicated. Specifically, degenerate codon substitutions can be achieved by generating sequences in which the third position of one or more selected (or all) codons is substituted with mixed base and/or deoxyinosine residues (Batzer et al. (1991) Nucleic Acid Res 19:5081; Ohtsuka et al. (1985) J Biol Chem 260:2605 2608; Rossolini et al. (1994) Mol Cell Probes 8:91 98). Thus, the term nucleotide includes both deoxyribonucleic acid (DNA) and ribonucleic acid, and therefore the term nucleotide specifically includes complementary DNA as used herein.

The isolated polypeptide can be formulated in a pharmaceutical composition along with a suitable pharmaceutical carrier known to one skilled in the art. As described above, the isolated polypeptide that is included in the pharmaceutical composition can comprise a BChE polypeptide, including variants and/or fragments thereof, and a second polypeptide, including variants and/or fragments thereof. In some embodiments, the isolated polypeptide formulated in a pharmaceutical composition can further comprise a linker disposed between the BChE polypeptide and the second polypeptide.

The term "pharmaceutically acceptable carrier" refers to sterile aqueous or nonaqueous solutions, dispersions, suspensions or emulsions, as well as sterile powders for reconstitution into sterile injectable solutions or dispersions just prior to use. Proper fluidity can be maintained, for example, by the use of coating materials such as lecithin, by the maintenance of the required particle size in the case of dispersions and by the use of surfactants. These compositions can also contain adjuvants such as preservatives, wetting agents, emulsifying agents and dispersing agents. Prevention of the action of microorganisms can be ensured by the inclusion of various antibacterial and antifungal agents such as paraben, chlorobutanol, phenol, sorbic acid and the like. It can also be desirable to include isotonic agents such as sugars, sodium chloride and the like. Prolonged absorption of the injectable pharmaceutical form can be brought about by the inclusion of agents, such as aluminum monostearate and gelatin, which delay absorption. Injectable depot forms are made by forming microencapsule matrices of the drug in biodegradable polymers such as polylactide-polyglycolide, poly(orthoesters) and poly(anhydrides). Depending upon the ratio of drug to polymer and the nature of the particular polymer employed, the rate of drug release can be controlled. Depot injectable formulations are also prepared by entrapping the drug in liposomes or microemulsions which are compatible with body tissues. The injectable formulations can be sterilized, for example, by filtration through a bacterial-retaining filter or by incorporating sterilizing agents in the form of sterile solid compositions which can be dissolved or dispersed in sterile water or other sterile injectable media just prior to use. Suitable inert carriers can include sugars such as lactose.

Suitable formulations include aqueous and non-aqueous sterile injection solutions that can contain antioxidants, buffers, bacteriostats, bactericidal antibiotics and solutes that render the formulation isotonic with the bodily fluids of the intended recipient; and aqueous and non-aqueous sterile suspensions, which can include suspending agents and thickening agents.

The compositions can take such forms as suspensions, solutions or emulsions in oily or aqueous vehicles, and can contain formulatory agents such as suspending, stabilizing and/or dispersing agents. Alternatively, the active ingredient can be in powder form for constitution with a suitable vehicle, e.g., sterile pyrogen-free water, before use.

The formulations can be presented in unit-dose or multi-dose containers, for example sealed ampoules and vials, and can be stored in a frozen or freeze-dried (lyophilized) condition requiring only the addition of sterile liquid carrier immediately prior to use.

For oral administration, the compositions can take the form of, for example, tablets or capsules prepared by a conventional technique with pharmaceutically acceptable excipients such as binding agents (e.g., pregelatinized maize starch, polyvinylpyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycollate); or wetting agents (e.g., sodium lauryl sulphate). The tablets can be coated by methods known in the art.

Liquid preparations for oral administration can take the form of, for example, solutions, syrups or suspensions, or they can be presented as a dry product for constitution with water or other suitable vehicle before use. Such liquid preparations can be prepared by conventional techniques with pharmaceutically acceptable additives such as suspending agents (e.g., sorbitol syrup, cellulose derivatives or hydrogenated edible fats); emulsifying agents (e.g. lecithin or acacia); non-aqueous vehicles (e.g., almond oil, oily esters, ethyl alcohol or fractionated vegetable oils); and preservatives (e.g., methyl or propyl-p-hydroxybenzoates or sorbic acid). The preparations can also contain buffer salts, flavoring, coloring and sweetening agents as appropriate. Preparations for oral administration can be suitably formulated to give controlled release of the active compound. For buccal administration the compositions can take the form of tablets or lozenges formulated in conventional manner.

The compositions can also be formulated as a preparation for implantation or injection. Thus, for example, the compounds can be formulated with suitable polymeric or hydrophobic materials (e.g., as an emulsion in an acceptable oil) or ion exchange resins, or as sparingly soluble derivatives (e.g., as a sparingly soluble salt). The compounds can also be formulated in rectal compositions, creams or lotions, or transdermal patches.

The present isolated polypeptides, whether or not they are in a pharmaceutical composition, include pharmaceutically acceptable salts thereof. Thus, any reference to an isolated polypeptides herein can include pharmaceutically acceptable salts of the isolated polypeptide. In this regard, the term "pharmaceutically acceptable salts" refers to salts prepared from pharmaceutically acceptable non-toxic bases or acids. When the compound of the present invention is acidic, its corresponding salt can be conveniently prepared from pharmaceutically acceptable non-toxic bases, including inorganic bases and organic bases. Salts derived from such inorganic bases include aluminum, ammonium, calcium, copper (-ic and -ous), ferric, ferrous, lithium, magnesium, manganese (-ic and -ous), potassium, sodium, zinc and the like salts. Others include the ammonium, calcium, magnesium, potassium and sodium salts. Salts derived from pharmaceutically acceptable organic non-toxic bases include salts of primary, secondary, and tertiary amines, as well as cyclic amines and substituted amines such as naturally occurring and synthesized substituted amines. Other pharmaceutically acceptable organic non-toxic bases from which salts can be formed include ion exchange resins such as, for example, arginine, betaine, caffeine, choline, N,N'-dibenzylethylenediamine, diethylamine, 2-diethylamino ethanol, 2-dimethylaminoethanol, ethanolamine, ethylenediamine, N-ethylmorpholine, N-ethylpiperidine, glucamine, glucosamine, histidine, hydrabamine, isopropylamine, lysine, methylglucamine, morpholine, piperazine, piperidine, polyamine resins, procaine, purines, theobromine, triethylamine, trimethylamine, tripropylamine, tromethamine and the like.

Additionally, the presently-disclosed subject matter includes methods for treating a cocaine-induced condition. In some embodiments treatment methods include administering to an individual (subject) an effective amount of the present isolated polypeptides (e.g., a fusion polypeptide comprising a BChE polypeptide and a second polypeptide, or variants and/or fragments of either) to lower blood cocaine concentration. The isolated polypeptide can be administered in the form of a pharmaceutical composition in which the isolated polypeptide is included with a suitable pharmaceutical carrier. Treatment of a cocaine-induced condition using one of the aforementioned isolated polypeptides can be in a manner that will be understood by those skilled in the art.

In this regard, the term "administering" refers to any method of providing a isolated polypepride and/or pharmaceutical composition thereof to a subject. Such methods are well known to those skilled in the art and include, but are not limited to, oral administration, transdermal administration, administration by inhalation, nasal administration, topical administration, intravaginal administration, ophthalmic administration, intraaural administration, intracerebral administration, rectal administration, and parenteral administration, including injectable such as intravenous administration, intra-arterial administration, intramuscular administration, subcutaneous administration, intravitreous administration, intracameral (into anterior chamber) administration, subretinal administration, sub-Tenon's administration, peribulbar administration, and the like. Administration can be continuous or intermittent. In various aspects, a preparation can be administered therapeutically; that is, administered to treat an existing cocaine-induced condition (e.g., cocaine overdose or cocaine addiction). In further various aspects, a preparation can be administered prophylactically; that is, administered for prevention of a cocaine-induced condition.

The dose for administration of an isolated polypeptide or pharmaceutical composition in accordance with the presently-described subject matter can be an amount which will be effective in lowering (−)-cocaine concentration in a patient's bloodstream. One would recognize that this amount will vary greatly depending on the nature of cocaine consumed, e.g., injected or inhaled and the condition of a patient. Furthermore, in some embodiments the isolated polypeptide should effectively lower (−)-cocaine concentration in blood over a predetermined time period, including time period of about 5 days, 10 days, 15 days, 20 days, 25 days, 30 days, 35 days, 40 days, 45 days, 50 days, 55 days, or 60 days. In some embodiments the isolated polypeptide has a biological half-life that is shorter than a predetermined time period in which the isolated polypeptide can effectively lower (−)-cocaine concentration. For instance, in some embodiments the isolated polypeptide can have a biological half-life of about 4 days, about 10 days, about 15 days, 20 days, 25 days, 30 days, 35 days, or 40 days.

Thus, an "effective amount" of isolated polypeptide or pharmaceutical composition to be used in accordance with the presently-disclosed subject matter is intended to mean a nontoxic but sufficient amount of the isolated polypeptide or pharmaceutical composition thereof, such that the desired prophylactic or therapeutic effect is produced. The exact amount of the isolated polypeptide or pharmaceutical composition that is required will vary from subject to subject, depending on the species, age, and general condition of the subject, the severity of the condition being treated, the particular carrier or adjuvant being used and its mode of administration, and the like. Similarly, the dosing regimen should also be adjusted to suit the individual to whom the composition is administered and will once again vary with age, weight, metabolism, etc. of the individual. Accordingly, the "effective amount" of any particular isolated polypeptide or pharmaceutical composition thereof will vary based on the particular circumstances, and an appropriate effective amount may be determined in each case of application by one of ordinary skill in the art using only routine experimentation.

The presently-disclosed subject matter is further illustrated by the following specific but non-limiting examples. The following examples may include compilations of data that are representative of data gathered at various times during the course of development and experimentation related to the presently-disclosed subject matter.

EXAMPLES

Embodiments of an isolated polypeptide comprising a BChE polypeptide and a second polypeptide, or variants and/or fragments thereof, were made and studied using the following experimental procedure. For each isolated polypeptide conceived, following site-directed mutagenesis, the isolated polypeptides were produced in a small scale for in vitro assays and pharmacokinetic assay in rats through transient transfection of the corresponding cDNA. Stable cell lines were produced for certain isolated polypeptides in large scale for more in vivo studies. One particular isolated polypeptide synthesized in this Example comprised a second polypeptide represented by SEQ ID NO: 6, a BChE polypeptide represented by SEQ ID NO: 48, and no linker therebetween.

Site-Directed Mutagenesis and Isolated Polypeptide Synthesis.

Briefly, site-directed mutagenesis of the isolated polypeptide's cDNA was performed by using the QuikChange method. Further mutations were generated from the cDNA in a pCMV-MCS expression plasmid. The isolated polypeptides were expressed in Chinese hamster ovary (CHO)-S cells using the freestyle CHO expression medium (Catalog #12651022; Invitrogen; Grand Island, N.Y.). The secreted isolated polypeptide in the collected culture medium was purified using affinity chromatography on Protein A sepharose with appropriate pH adjustment.

Generation of Recombinant Lentivirus Expressing Isolated Polypeptide.

cDNAs of the isolated polypeptide in lentivirus plasmids were constructed in pCSC-SP-PW vector at ApaI and XhoI I sites by PCR with the isolated polypeptides in pCMV-MCS plasmids as templates. The sequences of constructs were confirmed by DNA sequencing. Starting from one isolated polypeptide, the other isolated polypeptides, having mutations and/or fragments of either BChE or the second polypeptide, were generated by the QuickChange method. The lentiviruses encoding isolated polypeptides were then prepared.

Scaling Up Isolated Polypeptide Production.

Large-scale preparation of an isolated polypeptide was achieved first by infecting CHO-S cells with lentivirus followed by resuspending attached CHO-S cells in suspension culture in the freestyle CHO expression medium. See, e.g., Xue, L.; Hou, S.; Tong, M.; Fang, L.; Chen, X.; Jin, Z.; Tai, H.-H.; Zheng, F.; Zhan, C.-G. "Preparation and in vivo characterization of a cocaine hydrolase engineered from human butyrylcholinesterase for metabolizing cocaine", Biochem. J. 2013, 453, 447-454, which is incorporated herein by this reference. CHO-S cells were routinely suspension cultured in serum-free medium according to manufacturer's instruction at 8% $CO_2$, 37° C. on orbit shaker at 125 rpm. The day before infection, cells were loaded at $1 \times 10^5$/mL and cultured steadily in freestyle CHO expression medium with 1% FBS. Cells began to attach to plate soon after the change of culture condition. Lentivirus was then added to infect cells for 1 day with two intermittent additions of the virus. Infected cells were suspended by 0.05% trypsin-EDTA and seeded at 2 to 10 cells/well in 96-well plate in 1% FBS free-style medium again to culture for another 14 to 21 days without changing medium and shaking until single clones clearly appeared. Single-clone cell lines from 96-well plates were chosen to culture in 48-well plates, then 12-well plates and 6-well plates in 1% FBS freestyle CHO expression medium. High expression single-clone cell lines were screened and selected by determining BChE activity in medium. Selected cells were then changed back to suspension culture and the culture volume increased from 6-well plate to 125 ml flask and a series of larger flasks and finally 2-L flask. Culture medium was changed every 2 to 3 days and collected to store at 4° C. in sterilized bottles for protein purification. Each liter of culture medium was expected to contain about 7 to 20 mg of the isolated polypeptide. Thus, ~20 to 100 L culture medium was collected for each isolated polypeptide, depending on the need and expression. A 40 L Sterilizable-in-Place CelliGen 510 Bioreactor (New Brunswick, N.J.) was used for the larger-scale production of some of the promising isolated polypeptides. The secreted isolated polypeptide in the collected culture medium was purified using the same Protein A affinity chromatography as mentioned above.

Active-Site Titration.

The active-site concentration of the purified isolated polypeptide was determined by using a standard protocol through titration using an irreversible BChE inhibitor, diisopropylfluorophosphate (DFP). For the active-site titration, each enzyme was incubated for 24 h with varying concentrations of DFP, followed by the measurement of the residual BChE activity. In this way, the residual BChE activity was reduced linearly with increasing sub-stoichiometric amounts of DFP and, thus, the active-site concentration of the enzyme could be calculated by the intercept with the axis representing the DFP concentration.

In Vitro Activity Assay.

The catalytic activity of the isolated polypeptide against (−)-cocaine was determined by using the sensitive radiometric assay with [$^3$H]-(−)-cocaine labeled on its benzene ring. The assay is based on toluene extraction of product [$^3$H]-benzoic acid.

In Vivo Assay.

The pharmacokinetics, in vivo potency, and immunogenicity in rats was determined for each isolated polypeptide. Rats were anesthetized and given a single dose (0.1 or 1 mg/kg) of isolated polypeptide or PBS buffer (the negative control) via the tail vein. After the isolated polypeptide injection, blood samples (<50 μl) were collected from saphenous vein at 2 min, 15 min, 30 min, 1 hr, 2 hr, 3 hr, 5 hr, 8 hr, 12 hr, 1 day and every day within 15 days. The isolated polypeptide's activity in plasma was determined using the same radiometric [$^3$H]-(−)-cocaine assay as used for the above in vitro enzyme activity assay.

To characterize the in vivo catalytic activity of each isolated polypeptide against (−)-cocaine at a given time point (10 min, 5 hr, 1 day, 3 days, 7 days, and 14 days) after the isolated polypeptide injection, the anesthetized rats were given 5.6 mg/kg (−)-cocaine intravenously (i.v.). At 1 min, 2 min, 5 min, 10 min, 20 min, 30 min, 60 min, 90 min, and 120 min after the (−)-cocaine injection, a blood sample was collected from saphenous vein into heparin-treated tubes containing DFP. DFP was used to irreversibly inhibit the esterases (including injected isolated polypeptide, native BChE, and carboxylesterases) in plasma to terminate the enzymatic cocaine hydrolysis. The blood samples were centrifuged to obtain plasma which contains both (−)-cocaine (the drug) and its metabolites that could be analyzed by using a Waters Breeze HPLC system in the PI's lab. The time-dependent concentrations of cocaine and metabolites were fitted to the standard kinetic equation of the enzymatic (−)-cocaine hydrolysis along with an elimination model in order to determine the kinetic parameters ($V_{max}$ and $K_M$) of isolated polypeptide against (−)-cocaine in plasma.

To calculate the activity half life, the known formula for the time (t)-dependence of [E] was utilized, which follows a double exponential equation which accounts for both the enzyme distribution process (the fast phase, associated with $\alpha_1$) and elimination process (the slow phase, associated with $\alpha_2$). The biological half-life refers to the elimination process.

$$[E]=A\exp(-\alpha_1 t)+B\exp(-\alpha_2 t)$$

As shown in FIG. 1, the biological half-life of an isolated polypeptide comprising a second polypeptide represented by SEQ ID NO: 6, a BChE polypeptide represented by SEQ ID NO: 48, and no linker therebetween in rats was about 110 hr.

While the terms used herein are believed to be well understood by one of ordinary skill in the art, the definitions set forth herein are provided to facilitate explanation of the presently-disclosed subject matter.

Unless defined otherwise, all technical and scientific terms used herein have the same meaning as commonly understood by one of ordinary skill in the art to which the presently-disclosed subject matter belongs. Although any methods, devices, and materials similar or equivalent to those described herein can be used in the practice or testing of the presently-disclosed subject matter, representative methods, devices, and materials are now described.

Following long-standing patent law convention, the terms "a", "an", and "the" refer to "one or more" when used in this application, including the claims. Thus, for example, reference to "a protein" includes a plurality of such proteins, and so forth.

Unless otherwise indicated, all numbers expressing quantities of ingredients, properties such as reaction conditions, and so forth used in the specification and claims are to be understood as being modified in all instances by the term "about". Accordingly, unless indicated to the contrary, the numerical parameters set forth in this specification and claims are approximations that can vary depending upon the desired properties sought to be obtained by the presently-disclosed subject matter.

As used herein, the term "about," when referring to a value or to an amount of mass, weight, time, volume, concentration or percentage is meant to encompass variations of in some embodiments ±50%, in some embodiments ±40%, in some embodiments ±30%, in some embodiments ±20%, in some embodiments ±10%, in some embodiments ±5%, in some embodiments ±1%, in some embodiments ±0.5%, and in some embodiments ±0.1% from the specified amount, as such variations are appropriate to perform the disclosed method.

As used herein, ranges can be expressed as from "about" one particular value, and/or to "about" another particular value. It is also understood that there are a number of values disclosed herein, and that each value is also herein disclosed as "about" that particular value in addition to the value itself. For example, if the value "10" is disclosed, then "about 10" is also disclosed. It is also understood that each unit between two particular units are also disclosed. For example, if 10 and 15 are disclosed, then 11, 12, 13, and 14 are also disclosed.

SEQUENCE LISTING

| Fc Wild Type |
|---|
| SEQ ID NO: 1 |
| GCA GAG CCT AAG TCC TGC GAC AAA ACT CAC ACA TGC |
| CCA CCG TGC CCA GCA CCT GAA CTC CTG GGG GGA CCG |
| TCA GTC TTC CTC TTC CCC CCA AAA CCC AAG GAC ACC |
| CTC ATG ATC TCC CGG ACC CCT GAG GTC ACA TGC GTG |
| GTG GTG GAC GTG AGC CAC GAA GAC CCT GAG GTC AAG |
| TTC AAC TGG TAC GTG GAC GGC GTG GAG GTG CAT AAT |
| GCC AAG ACA AAG CCG CGG GAG GAG CAG TAC AAC AGC |
| ACG TAC CGT GTG GTC AGC GTC CTC ACC GTC CTG CAC |
| CAG GAC TGG CTG AAT GGC AAG GAG TAC AAG TGC AAG |
| GTC TCC AAC AAA GCC CTC CCA GCC CCC ATC GAG AAA |
| ACC ATC TCC AAA GCC AAA GGG CAG CCC CGA GAA CCA |
| CAG GTG TAC ACC CTG CCC CCA TCC CGG GAC GAG CTG |
| ACC AAG AAC CAG GTC AGC CTG ACC TGC CTG GTC AAA |
| GGC TTC TAT CCC AGC GAC ATC GCC GTG GAG TGG GAG |
| AGC AAT GGG CAG CCG GAG AAC AAC TAC AAG ACC ACG |
| CCT CCC GTG CTG GAC TCC GAC GGC TCC TTC TTC CTC |
| TAC AGC AAG CTC ACC GTG GAC AAG AGC AGG TGG CAG |
| CAG GGG AAC GTC TTC TCA TGC TCC GTG ATG CAC GAG |
| GCT CTG CAC AAC CAC TAC ACG CAG AAG AGC CTC TCC |
| CTG TCT CCG GGT AAA |

| Fc Wild Type |
|---|
| SEQ ID NO: 2: |
| AEPKSCDKTH TCPPCPAPEL LGGPSVFLFP PKPKDTLMIS |
| RTPEVTCVVV DVSHEDPEVK FNWYVDGVEV HNAKTKPREE |
| QYNSTYRVVS VLTVLHQDWL NGKEYKCKVS NKALPAPIEK |
| TISKAKGQPR EPQVYTLPPS RDELTKNQVS LTCLVKGFYP |
| SDIAVEWESN GQPENNYKTT PPVLDSDGSF FLYSKLTVDK |
| SRWQQGNVFS CSVMHEALHN HYTQKSLSLS PGK |

| Fc Wild Type Fragment |
|---|
| SEQ ID NO: 3: |
| GCA CCT GAA CTC CTG GGG GGA CCG TCA GTC TTC |
| CTC TTC CCC CCA AAA CCC AAG GAC ACC CTC ATG |
| ATC TCC CGG ACC CCT GAG GTC ACA TGC GTG GTG |

Fc Wild Type Fragment

```
GTG GAC GTG AGC CAC GAA GAC CCT GAG GTC AAG
TTC AAC TGG TAC GTG GAC GGC GTG GAG GTG CAT
AAT GCC AAG ACA AAG CCG CGG GAG GAG CAG TAC
AAC AGC ACG TAC CGT GTG GTC AGC GTC CTC ACC
GTC CTG CAC CAG GAC TGG CTG AAT GGC AAG GAG
TAC AAG TGC AAG GTC TCC AAC AAA GCC CTC CCA
GCC CCC ATC GAG AAA ACC ATC TCC AAA GCC AAA
GGG CAG CCC CGA GAA CCA CAG GTG TAC ACC CTG
CCC CCA TCC CGG GAC GAG CTG ACC AAG AAC CAG
GTC AGC CTG ACC TGC CTG GTC AAA GGC TTC TAT
CCC AGC GAC ATC GCC GTG GAG TGG GAG AGC AAT
GGG CAG CCG GAG AAC AAC TAC AAG ACC ACG CCT
CCC GTG CTG GAC TCC GAC GGC TCC TTC TTC CTC
TAC AGC AAG CTC ACC GTG GAC AAG AGC AGG TGG
CAG CAG GGG AAC GTC TTC TCA TGC TCC GTG ATG
CAC GAG GCT CTG CAC AAC CAC TAC ACG CAG AAG
AGC CTC TCC CTG TCT CCG GGT AAA
```

Fc Wild Type Fragment

SEQ ID NO: 4
```
     APEL LGGPSVFLFP PKPKDTLMIS
RTPEVTCVVV DVSHEDPEVK FNWYVDGVEV HNAKTKPREE
QYNSTYRVVS VLTVLHQDWL NGKEYKCKVS NKALPAPIEK
TISKAKGQPR EPQVYTLPPS RDELTKNQVS LTCLVKGFYP
SDIAVEWESN GQPENNYKTT PPVLDSDGSF FLYSKLTVDK
SRWQQGNVFS CSVMHEALHN HYTQKSLSLS PGK
```

Fc Mutant (Fe1)

SEQ ID NO: 5
```
GTG GAG CCT AAG TCC TGC GAC AAA ACT CAC ACA
TGC CCA CCG TGC CCA GCA CCT GAA CTC CTG GGG
GGA CCG TCA GTC TTC CTC TTC CCC CCA AAA CCC
AAG GAC ACC CTC ATG ATC TCC CGG ACC CCT GAG
GTC ACA TGC GTG GTG GTG GAC GTG AGC CAC GAA
GAC CCT GAG GTC AAG TTC AAC TGG TAC GTG GAC
GGC GTG GAG GTG CAT AAT GCC AAG ACA AAG CCG
CGG GAG GAG CAG TAC AAC AGC ACG TAC CGT GTG
GTC AGC GTC CTC ACC GTC CTG CAC CAG GAC TGG
CTG AAT GGC AAG GAG TAC AAG TGC AAG GTC TCC
AAC AAA GCC CTC CCA GCC CCC ATC GAG AAA ACC
ATC TCC AAA GCC AAA GGG CAG CCC CGA GAA CCA
CAG GTG TAC ACC CTG CCC CCA TCC CGG GAG GAG
ATG ACC AAG AAC CAG GTC AGC CTG ACC TGC CTG
GTC AAA GGC TTC TAT CCC AGC GAC ATC GCC GTG
GAG TGG GAG AGC AAT GGG CAG CCG GAG AAC AAC
TAC AAG ACC ACG CCT CCC GTG CTG GAC TCC GAC
GGC TCC TTC TTC CTC TAC AGC AAG CTC ACC GTG
GAC AAG AGC AGG TGG CAG CAG GGG AAC GTC TTC
TCA TGC TCC GTG ATG CAC GAG GCT CTG CAC AAC
CAC TAC ACG CAG AAG AGC CTC TCC CTG TCT CCG
GGT AAA
```

Fc Mutant (Fe1)

SEQ ID NO: 6
```
VEPKSCDKTH TCPPCPAPEL LGGPSVFLFP PKPKDTLMIS
RTPEVTCVVV DVSHEDPEVK FNWYVDGVEV HNAKTKPREE
QYNSTYRVVS VLTVLHQDWL NGKEYKCKVS NKALPAPIEK
TISKAKGQPR EPQVYTLPPS REEMTKNQVS LTCLVKGFYP
SDIAVEWESN GQPENNYKTT PPVLDSDGSF FLYSKLTVDK
SRWQQGNVFS CSVMHEALHN HYTQKSLSLS PGK
```

Fc Mutant (Fc2)

SEQ ID NO: 7
```
GTG GAG CCT AAG TCC TGC GAC AAA ACT CAC ACA
TGC CCA CCG TGC CCA GCA CCT GAA CTC CTG GGG
GGA CCG TCA GTC TTC CTC TTC CCC CCA AAA CCC
AAG GAC ACC CTC ATG ATC TCC CGG ACC CCT GAG
GTC ACA TGC GTG GTG GTG GAC GTG AGC CAC GAA
GAC CCT GAG GTC AAG TTC AAC TGG TAC GTG GAC
GGC GTC CAG GTG CAT AAT GCC AAG ACA AAG CCG
CGG GAG CAG CAG TAC AAC AGC ACG TAC CGT GTG
GTC AGC GTC CTC ACC GTC CTG CAC CAG AAT TGG
CTG GAC GGC AAG GAG TAC AAG TGC AAG GTC TCC
AAC AAA GCC CTC CCA GCC CCC ATC GAG AAA ACC
ATC TCC AAA GCC AAA GGG CAG CCC CGA GAA CCA
CAG GTG TAC ACC CTG CCC CCA TCC CGG GAG GAG
ATG ACC AAG AAC CAG GTC AGC CTG ACC TGC CTG
```

Fc Mutant (Fc2)

```
GTC AAA GGC TTC TAT CCC AGC GAC ATC GCC GTG
GAG TGG GAG AGC AAT GGG CAG CCG GAG AAC AAC
TAC AAG ACC ACG CCT CCC GTG CTG GAC TCC GAC
GGC TCC TTC TTC CTC TAC AGC AAG CTC ACC GTG
GAC AAG AGC AGG TGG CAG CAG GGG AAC GTC TTC
TCA TGC TCC GTG ATG CAC GAG GCT CTG CAC AAC
CAC TAC ACG CAG AAG AGC CTC TCC CTG TCT CCG
GGT AAA
```

Fc Mutant (FC2)

SEQ ID NO: 8
```
VEPKSCDKTH TCPPCPAPEL LGGPSVFLFP PKPKDTLMIS
RTPEVTCVVV DVSHEDPQVK FNWYVDGVQV HNAKTKPREQ
QYNSTYRVVS VLTVLHQNWL DGKEYKCKVS NKALPAPIEK
TISKAKGQPR EPQVYTLPPS REEMTKNQVS LTCLVKGFYP
SDIAVEWESN GQPENNYKTT PPVLDSDGSF FLYSKLTVDK
SRWQQGNVFS CSVMHEALHN HYTQKSLSLS PGK
```

Fc Mutant (Fc3)

SEQ ID NO: 9
```
CAG GAG CCT AAG TCC TCC GAC AAA ACT CAC ACA TCC
CCA CCG TCC CCA GCA CCT GAA CTC CTG GGG GGA TCC
TCA GTC TTC CTC TTC CCC CCA AAA CCC AAG GAC ACC
CTC ATG ATC TCC CGG ACC CCT GAG GTC ACA TGC GTG
GTG GTG GAC GTG AGC CAC GAA GAC CCT GAG GTC AAG
TTC AAC TGG TAC GTG GAC GGC GTG GAG GTG CAT AAT
GCC AAG ACA AAG CCG CGG GAG GAG CAG TAC AAC AGC
ACG TAC CGT GTG GTC AGC GTC CTC ACC GTC CTG CAC
CAG GAC TGG CTG AAT GGC AAG GAG TAC AAG TGC AAG
GTC TCC AAC AAA GCC CTC CCA GCC CCC ATC GAG AAA
ACC ATC TCC AAA GCC AAA GGG CAG CCC CGA GAA CCA
CAG GTG TAC ACC CTG CCC CCA TCC CGG GAG GAG CTG
ACC AAG AAC CAG GTC AGC CTG ACC TGC CTG GTC AAA
GGC TTC TAT CCC AGC GAC ATC GCC GTG GAG TGG GAG
AGC AAT GGG CAG CCG GAG AAC AAC TAC AAG ACC ACG
CCT CCC GTG CTG GAC TCC GAC GGC TCC TTC TTC CTC
TAC AGC AAG CTC ACC GTG GAC AAG AGC AGG TGG CAG
CAG GGG AAC GTC TTC TCA TGC TCC GTG ATG CAC GAG
GCT CTG CAC AAC CAC TAC ACG CAG AAG AGC CTC TCC
CTG TCT CCG GGT AAA
```

Fc Mutant (Fc3)

SEQ ID NO: 10
```
QEPKSSDKTH TSPPSPAPEL LGGSSVFLFP PKPKDTLMIS
RTPEVTCVVV DVSHEDPEVK FNWYVDGVEV HNAKTKPREE
QYNSTYRVVS VLTVLHQDWL NGKEYKCKVS NKALPAPIEK
TISKAKGQPR EPQVYTLPPS REELTKNQVS LTCLVKGFYP
SDIAVEWESN GQPENNYKTT PPVLDSDGSF FLYSKLTVDK
SRWQQGNVFS CSVMHEALHN HYTQKSLSLS PGK
```

Fc Mutant (Fc4)

SEQ ID NO: 11
```
GTG GAG CCT AAG TCC TGC GAC AAA ACT CAC ACA TGC
CCA CCG TGC CCA GCA CCT GAA CTC CTG GGG GGA CCG
TCA GTC TTC CTC TTC CCC CCA AAA CCC AAG GAC ACC
CTC TAT ATC TCC CGG ACC CCT GAG GTC ACA TGC GTG
GTG GTG GAC GTG AGC CAC GAA GAC CCT GAG GTC AAG
TTC AAC TGG TAC GTG GAC GGC GTG GAG GTG CAT AAT
GCC AAG ACA AAG CCG CGG GAG GAG CAG TAC AAC AGC
ACG TAC CGT GTG GTC AGC GTC CTC ACC GTC CTG CAC
CAG GAC TGG CTG AAT GGC AAG GAG TAC AAG TGC AAG
GTC TCC AAC AAA GCC CTC CCA GCC CCC ATC GAG AAA
ACC ATC TCC AAA GCC AAA GGG CAG CCC CGA GAA CCA
CAG GTG TAC ACC CTG CCC CCA TCC CGG GAG GAG ATG
ACC AAG AAC CAG GTC AGC CTG ACC TGC CTG GTC AAA
GGC TTC TAT CCC AGC GAC ATC GCC GTG GAG TGG GAG
AGC AAT GGG CAG CCG GAG AAC AAC TAC AAG ACC ACG
CCT CCC GTG CTG GAC TCC GAC GGC TCC TTC TTC CTC
TAC AGC AAG CTC ACC GTG GAC AAG AGC AGG TGG CAG
CAG GGG AAC GTC TTC TCA TGC TCC GTG ATG CAC GAG
GCT CTG CAC AAC CAC TAC ACG CAG AAG AGC CTC TCC
CTG TCT CCG GGT AAA
```

Fc Mutant (Fc4)

SEQ ID NO: 12
```
VEPKSCDKTH TCPPCPAPEL LGGPSVFLFP PKPKDTLYIS
RTPEVTCVVV DVSHEDPEVK FNWYVDGVEV HNAKTKPREE
```

Fc Mutant (Fc4)

QYNSTYRVVS VLTVLHQDWL NGKEYKCKVS NKALPAPIEK
TISKAKGQPR EPQVYTLPPS REEMTKNQVS LTCLVKGFYP
SDIAVEWESN GQPENNYKTT PPVLDSDGSF FLYSKLTVDK
SRWQQGNVFS CSVMHEALHN HYTQKSLSLS PGK

Fc Mutant (Fc5)

SEQ ID NO: 13
GTG GAG CCT AAG TCC TGC GAC AAA ACT CAC ACA
TGC CCA CCG TGC CCA GCA CCT GAA CTC CTG GGG
GGA CCG TCA GTC TTC CTC TTC CCC CCA AAA CCC
AAG GAC ACC CTC ATG ATC TCC CGG GAA CCT GAG
GTC ACA TGC GTG GTG GTG GAC GTG AGC CAC GAA
GAC CCT GAG GTC AAG TTC AAC TGG TAC GTG GAC
GGC GTG GAG GTG CAT AAT GCC AAG ACA AAG CCG
CGG GAG GAG CAG TAC AAC AGC ACG TAC CGT GTG
GTC AGC GTC CTC ACC GTC CTG CAC CAG GAC TGG
CTG AAT GGC AAG GAG TAC AAG TGC AAG GTC TCC
AAC AAA GCC CTC CCA GCC CCC ATC GAG AAA ACC
ATC TCC AAA GCC AAA GGG CAG CCC CGA GAA CCA
CAG GTG TAC ACC CTG CCC CCA TCC CGG GAG GAG
ATG ACC AAG AAC CAG GTC AGC CTG ACC TGC CTG
GTC AAA GGC TTC TAT CCC AGC GAC ATC GCC GTG
GAG TGG GAG AGC AAT GGG CAG CCG GAG AAC AAC
TAC AAG ACC ACG CCT CCC GTG CTG GAC TCC GAC
GGC TCC TTC TTC CTC TAC AGC AAG CTC ACC GTG
GAC AAG AGC AGG TGG CAG CAG GGG AAC GTC TTC
TCA TGC TCC GTG ATG CAC GAG GCT CTG CAC AAC
CAC TAC ACG CAG AAG AGC CTC TCC CTG TCT CCG
GGT AAA

Fc Mutant (Fc5)

SEQ ID NO: 14
VEPKSCDKTH TCPPCPAPEL LGGPSVFLFP PKPKDTLMIS
REPEVTCVVV DSHEDPEVK FNWYVDGVEV HNAKTKPREE
QYNSTYRVVS VLTVLHQDWL NGKEYKCKVS NKALPAPIEK
TISKAKGQPR EPQVYTLPPS REEMTKNQVS LTCLVKGFYP
SDIAVEWESN GQPENNYKTT PPVLDSDGSF FLYSKLTVDK
SRWQQGNVFS CSVMHEALHN HYTQKSLSLS PGK

Fc Mutant (Fc6)

SEQ ID NO: 15
GTG GAG CCT AAG TCC TGC GAC AAA ACT CAC ACA
TGC CCA CCG TGC CCA GCA CCT GAA CTC CTG GGG
GGA CCG TCA GTC TTC CTC TTC CCC CCA AAA CCC
AAG GAC ACC CTC TAT ATC ACC CGG ACC CCT GAG
GTC ACA TGC GTG GTG GTG GAC GTG AGC CAC GAA
GAC CCT GAG GTC AAG TTC AAC TGG TAC GTG GAC
GGC GTG GAG GTG CAT AAT GCC AAG ACA AAG CCG
CGG GAG GAG CAG TAC AAC AGC ACG TAC CGT GTG
GTC AGC GTC CTC ACC GTC CTG CAC CAG GAC TGG
CTG AAT GGC AAG GAG TAC AAG TGC AAG GTC TCC
AAC AAA GCC CTC CCA GCC CCC ATC GAG AAA ACC
ATC TCC AAA GCC AAA GGG CAG CCC CGA GAA CCA
CAG GTG TAC ACC CTG CCC CCA TCC CGG GAG GAG
ATG ACC AAG AAC CAG GTC AGC CTG ACC TGC CTG
GTC AAA GGC TTC TAT CCC AGC GAC ATC GCC GTG
GAG TGG GAG AGC AAT GGG CAG CCG GAG AAC AAC
TAC AAG ACC ACG CCT CCC GTG CTG GAC TCC GAC
GGC TCC TTC TTC CTC TAC AGC AAG CTC ACC GTG
GAC AAG AGC AGG TGG CAG CAG GGG AAC GTC TTC
TCA TGC TCC GTG ATG CAC GAG GCT CTG CAC AAC
CAC TAC ACG CAG AAG AGC CTC TCC CTG TCT CCG
GGT AAA

Fc Mutant (Fc6)

SEQ ID NO: 16
VEPKSCDKTH TCPPCPAPEL LGGPSVFLFP PKPKDTLYIT
RTPEVTCVVV DVSHEDPEVK FNWYVDGVEV HNAKTKPREE
QYNSTYRVVS VLTVLHQDWL NGKEYKCKVS NKALPAPIEK
TISKAKGQPR EPQVYTLPPS REEMTKNQVS LTCLVKGFYP
SDIAVEWESN GQPENNYKTT PPVLDSDGSF FLYSKLTVDK
SRWQQGNVFS CSVMHEALHN HYTQKSLSLS PGK

Fc Mutant (Fc7)

SEQ ID NO: 17
GTG GAG CCT AAG TCC TGC GAC AAA ACT CAC ACA
TGC CCA CCG TGC CCA GCA CCT GAA CTC CTG GGG
GGA CCG TCA GTC TTC CTC TTC CCC CCA AAA CCC
AAG GAC ACC CTC TAT ATC ACC CGG GAA CCT GAG
GTC ACA TGC GTG GTG GTG GAC GTG AGC CAC GAA

Fc Mutant (Fc7)

```
GAC CCT GAG GTC AAG TTC AAC TGG TAC GTG GAC
GGC GTG GAG GTG CAT AAT GCC AAG ACA AAG CCG
CGG GAG GAG CAG TAC AAC AGC ACG TAC CGT GTG
GTC AGC GTC CTC ACC GTC CTG CAC CAG GAC TGG
CTG AAT GGC AAG GAG TAC AAG TGC AAG GTC TCC
AAC AAA GCC CTC CCA GCC CCC ATC GAG AAA ACC
ATC TCC AAA GCC AAA GGG CAG CCC CGA GAA CCA
CAG GTG TAC ACC CTG CCC CCA TCC CGG GAG GAG
ATG ACC AAG AAC CAG GTC AGC CTG ACC TGC CTG
GTC AAA GGC TTC TAT CCC AGC GAC ATC GCC GTG
GAG TGG GAG AGC AAT GGG CAG CCG GAG AAC AAC
TAC AAG ACC ACG CCT CCC GTG CTG GAC TCC GAC
GGC TCC TTC TTC CTC TAC AGC AAG CTC ACC GTG
GAC AAG AGC AGG TGG CAG CAG GGG AAC GTC TTC
TCA TGC TCC GTG ATG CAC GAG GCT CTG CAC AAC
CAC TAC ACG CAG AAG AGC CTC TCC CTG TCT CCG
GGT AAA
```

Fc Mutant (Fc7)

SEQ ID NO: 18

VEPKSCDKTH TCPPCPAPEL LGGPSVFLFP PKPKDTLYIT
REPEVTCVVV DVSHEDPEVK FNWYVDGVEV HNAKTKPREE
QYNSTYRVVS VLTVLHQDWL NGKEYKCKVS NKALPAPIEK
TISKAKGQPR EPQVYTLPPS REEMTKNQVS LTCLVKGFYP
SDIAVEWESN GQPENNYKTT PPVLDSDGSF FLYSKLTVDK
SRWQQGNVFS CSVMHEALHN HYTQKSLSLS PGK

Fc Mutant (Fc8)

SEQ ID NO: 19

```
CAG GAG CCT AAG TCC TCC GAC AAA ACT CAC ACA
TCC CCA CCG TCC CCA GCA CCT GAA CTC CTG GGG
GGA TCC TCA GTC TTC CTC TTC CCC CCA AAA CCC
AAG GAC ACC CTC TAT ATC TCC CGG ACC CCT GAG
GTC ACA TGC GTG GTG GTG GAC GTG AGC CAC GAA
GAC CCT GAG GTC AAG TTC AAC TGG TAC GTG GAC
GGC GTG GAG GTG CAT AAT GCC AAG ACA AAG CCG
CGG GAG GAG CAG TAC AAC AGC ACG TAC CGT GTG
GTC AGC GTC CTC ACC GTC CTG CAC CAG GAC TGG
CTG AAT GGC AAG GAG TAC AAG TGC AAG GTC TCC
AAC AAA GCC CTC CCA GCC CCC ATC GAG AAA ACC
ATC TCC AAA GCC AAA GGG CAG CCC CGA GAA CCA
CAG GTG TAC ACC CTG CCC CCA TCC CGG GAC GAG
CTG ACC AAG AAC CAG GTC AGC CTG ACC TGC CTG
GTC AAA GGC TTC TAT CCC AGC GAC ATC GCC GTG
GAG TGG GAG AGC AAT GGG CAG CCG GAG AAC AAC
TAC AAG ACC ACG CCT CCC GTG CTG GAC TCC GAC
GGC TCC TTC TTC CTC TAC AGC AAG CTC ACC GTG
GAC AAG AGC AGG TGG CAG CAG GGG AAC GTC TTC
TCA TGC TCC GTG ATG CAC GAG GCT CTG CAC AAC
CAC TAC ACG CAG AAG AGC CTC TCC CTG TCT CCG
GGT AAA
```

Fc Mutant (Fc8)

SEQ ID NO: 20

QEPKSSDKTH TSPPSPAPEL LGGSSVFLFP PKPKDTLYIS
RTPEVTCVVV DVSHEDPEVK FNWYVDGVEV HNAKTKPREE
QYNSTYRVVS VLTVLHQDWL NGKEYKCKVS NKALPAPIEK
TISKAKGQPR EPQVYTLPPS RDELTKNQVS LTCLVKGFYP
SDIAVEWESN GQPENNYKTT PPVLDSDGSF FLYSKLTVDK
SRWQQGNVFS CSVMHEALHN HYTQKSLSLS PGK

Fc Mutant (Fc9)

SEQ ID NO: 21

```
CAG GAG CCT AAG TCC TCC GAC AAA ACT CAC ACA
TCC CCA CCG TCC CCA GCA CCT GAA CTC CTG GGG
GGA TCC TCA GTC TTC CTC TTC CCC CCA AAA CCC
AAG GAC ACC CTC TAT ATC ACC CGG ACC CCT GAG
GTC ACA TGC GTG GTG GTG GAC GTG AGC CAC GAA
GAC CCT GAG GTC AAG TTC AAC TGG TAC GTG GAC
GGC GTG GAG GTG CAT AAT GCC AAG ACA AAG CCG
CGG GAG GAG CAG TAC AAC AGC ACG TAC CGT GTG
GTC AGC GTC CTC ACC GTC CTG CAC CAG GAC TGG
CTG AAT GGC AAG GAG TAC AAG TGC AAG GTC TCC
AAC AAA GCC CTC CCA GCC CCC ATC GAG AAA ACC
ATC TCC AAA GCC AAA GGG CAG CCC CGA GAA CCA
CAG GTG TAC ACC CTG CCC CCA TCC CGG GAC GAG
CTG ACC AAG AAC CAG GTC AGC CTG ACC TGC CTG
```

Fc Mutant (Fc9)

```
GTC AAA GGC TTC TAT CCC AGC GAC ATC GCC GTG
GAG TGG GAG AGC AAT GGG CAG CCG GAG AAC AAC
TAC AAG ACC ACG CCT CCC GTG CTG GAC TCC GAC
GGC TCC TTC TTC CTC TAC AGC AAG CTC ACC GTG
GAC AAG AGC AGG TGG CAG CAG GGG AAC GTC TTC
TCA TGC TCC GTG ATG CAC GAG GCT CTG CAC AAC
CAC TAC ACG CAG AAG AGC CTC TCC CTG TCT CCG
GGT AAA
```

Fc Mutant (Fc9)

SEQ ID NO: 22

```
QEPKSSDKTH TSPPSPAPEL LGGSSVFLFP PKPKDTLYIT
RTPEVTCVVV DVSHEDPEVK FNWYVDGVEV HNAKTKPREE
QYNSTYRVVS VLTVLHQDWL NGKEYKCKVS NKALPAPIEK
TISKAKGQPR EPQVYTLPPS RDELTKNQVS LTCLVKGFYP
SDIAVEWESN GQPENNYKTT PPVLDSDGSF FLYSKLTVDK
SRWQQGNVFS CSVMHEALHN HYTQKSLSLS PGK
```

Fc Mutant (Fc10)

SEQ ID NO: 23

```
CAG GAG CCT AAG TCC TCC GAC AAA ACT CAC ACA
TCC CCA CCG TCC CCA GCA CCT GAA CTC CTG GGG
GGA TCC TCA GTC TTC CTC TTC CCC CCA AAA CCC
AAG GAC ACC CTC TAT ATC ACC CGG GAA CCT GAG
GTC ACA TGC GTG GTG GTG GAC GTG AGC CAC GAA
GAC CCT GAG GTC AAG TTC AAC TGG TAC GTG GAC
GGC GTG GAG GTG CAT AAT GCC AAG ACA AAG CCG
CGG GAG GAG CAG TAC AAC AGC ACG TAC CGT GTG
GTC AGC GTC CTC ACC GTC CTG CAC CAG GAC TGG
CTG AAT GGC AAG GAG TAC AAG TGC AAG GTC TCC
AAC AAA GCC CTC CCA GCC CCC ATC GAG AAA ACC
ATC TCC AAA GCC AAA GGG CAG CCC CGA GAA CCA
CAG GTG TAC ACC CTG CCC CCA TCC CGG GAC GAG
CTG ACC AAG AAC CAG GTC AGC CTG ACC TGC CTG
GTC AAA GGC TTC TAT CCC AGC GAC ATC GCC GTG
GAG TGG GAG AGC AAT GGG CAG CCG GAG AAC AAC
TAC AAG ACC ACG CCT CCC GTG CTG GAC TCC GAC
GGC TCC TTC TTC CTC TAC AGC AAG CTC ACC GTG
GAC AAG AGC AGG TGG CAG CAG GGG AAC GTC TTC
TCA TGC TCC GTG ATG CAC GAG GCT CTG CAC AAC
CAC TAC ACG CAG AAG AGC CTC TCC CTG TCT CCG
GGT AAA
```

Fc Mutant (Fc10)

SEQ ID NO: 24

```
QEPKSSDKTH TSPPSPAPEL LGGSSVFLFP PKPKDTLYIT
REPEVTCVVV DVSHEDPEVK FNWYVDGVEV HNAKTKPREE
QYNSTYRVVS VLTVLHQDWL NGKEYKCKVS NKALPAPIEK
TISKAKGQPR EPQVYTLPPS RDELTKNQVS LTCLVKGFYP
SDIAVEWESN GQPENNYKTT PPVLDSDGSF FLYSKLTVDK
SRWQQGNVFS CSVMHEALHN HYTQKSLSLS PGK
```

BChE Wild Type (1-574)

SEQ ID NO: 25

```
GAA GAT GAC ATC ATA ATT GCA ACA AAG AAT GGA
AAA GTC AGA GGG ATG AAC TTG ACA GTT TTT GGT
GGC ACG GTA ACA GCC TTT CTT GGA ATT CCC TAT
GCA CAG CCA CCT CTT GGT AGA CTT CGA TTC AAA
AAG CCA CAG TCT CTG ACC AAG TGG TCT GAT ATT
TGG AAT GCC ACA AAA TAT GCA AAT TCT TGC TGT
CAG AAC ATA GAT CAA AGT TTT CCA GGC TTC CAT
GGA TCA GAG ATG TGG AAC CCA AAC ACT GAC CTC
AGT GAA GAC TGT TTA TAT CTA AAT GTA TGG ATT
CCA GCA CCT AAA CCA AAA AAT GCC ACT GTA TTG
ATA TGG ATT TAT GGT GGT GGT TTT CAA ACT GGA
ACA TCA TCT TTA CAT GTT TAT GAT GGC AAG TTT
CTG GCT CGG GTT GAA AGA GTT ATT GTA GTG TCA
ATG AAC TAT AGG GTG GGT GCC CTA GGA TTC TTA
GCT TTG CCA GGA AAT CCT GAG GCT CCA GGG AAC
ATG GGT TTA TTT GAT CAA CAG TTG GCT CTT CAG
TGG GTT CAA AAA AAT ATA GCA GCC TTT GGT GGA
AAT CCT AAA AGT GTA ACT CTC TTT GGA GAA AGT
GCA GGA GCA GCT TCA GTT AGC CTG CAT TTG CTT
TCT CCT GGA AGC CAT TCA TTG TTC ACC AGA GCC
ATT CTG CAA AGT GGT TCC TTT AAT GCT CCT TGG
GCG GTA ACA TCT CTT TAT GAA GCT AGG AAC AGA
ACG TTG AAC TTA GCT AAA TTG ACT GGT TGC TCT
```

| BChE Wild Type (1-574) |
|---|
| AGA GAG AAT GAG ACT GAA ATA ATC AAG TGT CTT |
| AGA AAT AAA GAT CCC CAA GAA ATT CTT CTG AAT |
| GAA GCA TTT GTT GTC CCC TAT GGG ACT CCT TTG |
| TCA GTA AAC TTT GGT CCG ACC GTG GAT GGT GAT |
| TTT CTC ACT GAC ATG CCA GAC ATA TTA CTT GAA |
| CTT GGA CAA TTT AAA AAA ACC CAG ATT TTG GTG |
| GGT GTT AAT AAA GAT GAA GGG ACA GCT TTT TTA |
| GTC TAT GGT GCT CCT GGC TTC AGC AAA GAT AAC |
| AAT AGT ATC ATA ACT AGA AAA GAA TTT CAG GAA |
| GGT TTA AAA ATA TTT TTT CCA GGA GTG AGT GAG |
| TTT GGA AAG GAA TCC ATC CTT TTT CAT TAC ACA |
| GAC TGG GTA GAT GAT CAG AGA CCT GAA AAC TAC |
| CGT GAG GCC TTG GGT GAT GTT GTT GGG GAT TAT |
| AAT TTC ATA TGC CCT GCC TTG GAG TTC ACC AAG |
| AAG TTC TCA GAA TGG GGA AAT AAT GCC TTT TTC |
| TAC TAT TTT GAA CAC CGA TCC TCC AAA CTT CCG |
| TGG CCA GAA TGG ATG GGA GTG ATG CAT GGC TAT |
| GAA ATT GAA TTT GTC TTT GGT TTA CCT CTG GAA |
| AGA AGA GAT AAT TAC ACA AAA GCC GAG GAA ATT |
| TTG AGT AGA TCC ATA GTG AAA CGG TGG GCA AAT |
| TTT GCA AAA TAT GGG AAT CCA AAT GAG ACT CAG |
| AAC AAT AGC ACA AGC TGG CCT GTC TTC AAA AGC |
| ACT GAA CAA AAA TAT CTA ACC TTG AAT ACA GAG |
| TCA ACA AGA ATA ATG ACG AAA CTA CGT GCT CAA |
| CAA TGT CGA TTC TGG ACA TCA TTT TTT CCA AAA |
| GTC TTG GAA ATG ACA GGA AAT ATT GAT GAA GCA |
| GAA TGG GAG TGG AAA GCA GGA TTC CAT CGC TGG |
| AAC AAT TAC ATG ATG GAC TGG AAA AAT CAA TTT |
| AAC GAT TAC ACT AGC AAG AAA GAA AGT TGT GTG |
| GGT CTC |

| BChE Wild Type (1-574) |
|---|
| SEQ ID NO: 26<br>EDDIIIATKNGKVRGMNLTVFGGTVTAFLGIPYAQPPLGRLRFKKPQSL<br>TKWSDIWNATKYANSCCQNIDQSFPGFHGSEMWNPNTDLSEDCLYLNVW<br>IPAPKPKNATVLIWIYGGGFQTGTSSLHVYDGKFLARVERVIVVSMNYR<br>VGALGFLALPGNPEAPGNMGLFDQQLALQWVQKNIAAFGGNPKSVTLFG<br>ESAGAASVSLHLLSPGSHSLFTRAILQSGSFNAPWAVTSLYEARNRTLN |

| BChE Wild Type (1-574) |
|---|
| LAKLTGCSRENETEIIKCLRNKDPQEILLNEAFVVPYGTPLSVNFGPTV<br>DGDFLTDMPDILLELGQFKKTQILVGVNKDEGTAFLVYGAPGFSKDNNS<br>IITRKEFQEGLKIFFPGVSEFGKESILFHYTDWVDDQRPENYREALGDV<br>VGDYNFICPALEFTKKFSEWGNNAFFYYFEHRSSKLPWPEWMGVMHGYE<br>IEFVFGLPLERRDNYTKAEEILSRSIVKRWANFAKYGNPNETQNNSTSW<br>PVFKSTEQKYLTLNTESTRIMTKLRAQQCRFWTSFFPKVLEMTGNIDEA<br>EWEWKAGFHRWNNYMMDWKNQFNDYTSKKESCVGL |

REFERENCES

Throughout this document, various references are mentioned. All such references, including those listed below, are incorporated herein by reference in their entirety.

1. Braman, J.; Papworth, C.; Greener, A. "Site-directed mutagenesis using double-stranded plasmid DNA templates", Methods Mol. Biol. 1996, 57, 31-44.
2. Gao, Y.; LaFleur, D.; Shah, R.; Zhao, Q.; Singh, M.; Brimijoin, S. "An albumin-butyrylcholinesterase for cocaine toxicity and addiction: catalytic and pharmacokinetic properties", Chem Biol Interact. 2008, 175, 83-87.
3. Zheng, F.; Zhan, C.-G. "Modeling of kinetics of cocaine in living system reveals the feasibility for development of enzyme therapies for drugs of abuse", PLoS Comput. Biol. 2012, 2012, 8(7): e1002610. Epub 2012 Jul. 26.
4. Kronman, C.; Chitlaru, T.; Elhanany, E.; Velan, B.; Shafferman, A. "Hierarchy of posttranslational modifications involved in the circulatory longevity of glycoproteins. Demonstration of concerted contributions of glycan sialylation and subunit assembly to the pharmacokinetic behavior of bovine acetylcholinesterase", J Biol Chem. 2000, 275, 29488-29502.
5. Xue, L.; Hou, S.; Tong, M.; Fang, L.; Chen, X.; Jin, Z.; Tai, H.-H.; Zheng, F.; Zhan, C.-G. "Preparation and in vivo characterization of a cocaine hydrolase engineered from human butyrylcholinesterase for metabolizing cocaine", Biochem. J. 2013, 453, 447-454.
6. U.S. Pat. No. 7,438,904
7. U.S. Pat. No. 7,731,957
8. U.S. Pat. No. 7,919,082
9. U.S. Pat. No. 8,193,327
10. U.S. Pat. No. 8,399,644
11. U.S. patent application Ser. No. 13/767,418
12. U.S. Pat. No. 7,740,840
13. U.S. Pat. No. 7,892,537
14. U.S. Pat. No. 8,206,703
15. U.S. patent application Ser. No. 13/479,899
16. U.S. patent application Ser. No. 13/399,406
17. U.S. patent application Ser. No. 14/061,405

SEQUENCE LISTING (182 sequences)

SEQ ID NO: 1 - DNA, 699 bp, Homo sapiens
gcagagcctaagtcctgcgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggacgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaa

SEQ ID NO: 2 - protein, 233 aa, Homo sapiens
AEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3 - DNA, 651 bp, Artificial Sequence
  Synthesized
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggacgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaa

SEQ ID NO: 4 - protein, 217 aa, Artificial Sequence
  Synthesized
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - DNA, 699 bp, Artificial Sequence
  Synthesized
gtggagcctaagtcctgcgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaa

SEQ ID NO: 6 - protein, 233 aa, Artificial Sequence
  Synthesized
VEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7 - DNA, 699 bp, Artificial Sequence
  Synthesized
gtggagcctaagtcctgcgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctcaggtcaagttcaactggtacgtggacggcgtgcaggtgcataatgccaagacaaagccgcgggagcagcagtacaacagcacgtaccgtgtggtcagcgtcctcaccgtcctgcaccagaattggctggacggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaa

SEQ ID NO: 8 - protein, 233 aa, Artificial Sequence
  Synthesized
VEPKSCDKTHTCPPCPAPELLGGPSVFLFPPKPKDTLMISRTPEVTCVVVDVSHEDPQVKFNWYVDGVQVHNAKTKPREQQYNSTYRVVSVLTVLHQNWLDGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9 - DNA, 699 bp, Artificial Sequence
  Synthesized
caggagcctaagtcctccgacaaaactcacacatccccaccgtccccagcacctgaactcctggggggatcctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggacgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaa

SEQ ID NO: 10 - protein, 233 aa, Artificial Sequence
  Synthesized
QEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - DNA, 699 bp, Artificial Sequence
  Synthesized
gtggagcctaagtcctgcgacaaaactcacacatgcccaccgtgcccagcacctgaactcctggggggaccgtcagtcttcctcttccccccaaaacccaaggacaccctctatatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaa

SEQ ID NO: 12 - protein, 233 aa, Artificial Sequence
  Synthesized
VEPKSCDKTHTCPPCPAPELLGGPSVFLFPPKPKDTLYISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13 - DNA, 699 bp, Artificial Sequence
  Synthesized
gtggagcctaagtcctgcgacaaaactcacacatgcccaccgtgcccagcacctgaactcctggggggaccgtcagtcttcctcttccccccaaaacccaaggacaccctcatgatctcccgggaacctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaa

SEQ ID NO: 14 - protein, 233 aa, Artificial Sequence
  Synthesized
VEPKSCDKTHTCPPCPAPELLGGPSVFLFPPKPKDTLMISREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15 - DNA, 699 bp, Artificial Sequence
  Synthesized
gtggagcctaagtcctgcgacaaaactcacacatgcccaccgtgcccagcacctgaactcctggggggaccgtcagtcttcctcttccccccaaaacccaaggacaccctctatatcacccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaa

SEQ ID NO: 16 - protein, 233 aa, Artificial Sequence
  Synthesized
VEPKSCDKTHTCPPCPAPELLGGPSVFLFPPKPKDTLYITRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - DNA, 699 bp, Artificial Sequence
  Synthesized
gtggagcctaagtcctgcgacaaaactcacacatgcccaccgtgcccagcacctgaactcctggggggaccgtcagtcttcctcttccccccaaaacccaaggacaccctctatatcacccgggaacctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaa

SEQ ID NO: 18 - protein, 233 aa, Artificial Sequence
  Synthesized
VEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 19 - DNA, 699 bp, Artificial Sequence
  Synthesized
caggagcctaagtcctccgacaaaactcacacatccccaccgtccccagcacctgaactcctggggggatcctcagtcttcctcttccccccaaaacccaaggacaccctctatatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggacgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaa

SEQ ID NO: 20 - protein, 233 aa, Artificial Sequence
  Synthesized
QEPKSSDKTHTSPPSPAPELLGGSSVFLFPPKPKDTLYISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21 - DNA, 699 bp, Artificial Sequence
  Synthesized
caggagcctaagtcctccgacaaaactcacacatccccaccgtccccagcacctgaactcctggggggatcctcagtcttcctcttccccccaaaacccaaggacaccctctatatcacccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggacgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaa

SEQ ID NO: 22 - protein, 233 aa, Artificial Sequence
  Synthesized
QEPKSSDKTHTSPPSPAPELLGGSSVFLFPPKPKDTLYITRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23 - DNA, 699 bp, Artificial Sequence
  Synthesized
caggagcctaagtcctccgacaaaactcacacatccccaccgtccccagcacctgaactcctggggggatcctcagtcttcctcttccccccaaaacccaaggacaccctctatatcacccgggaacctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggacgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaa

SEQ ID NO: 24 - protein, 233 aa, Artificial Sequence
  Synthesized
QEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25 - DNA, 1722 bp, Homo sapiens
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggttcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 26 - protein, 574 aa, Homo sapiens
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 27 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 28 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 29 - DNA, 1593 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaa

SEQ ID NO: 30 - protein, 531 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLE

SEQ ID NO: 31 - DNA, 1587 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtc

SEQ ID NO: 32 - protein, 529 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKV

SEQ ID NO: 33 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 34 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 35 - DNA, 1593 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaa

SEQ ID NO: 36 - protein, 531 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLE

SEQ ID NO: 37 - DNA, 1587 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtc

SEQ ID NO: 38 - protein, 529 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKV

SEQ ID NO: 39 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 40 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 41 - DNA, 1593 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaa

SEQ ID NO: 42 - protein, 531 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLE

SEQ ID NO: 43 - DNA, 1587 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtc

SEQ ID NO: 44 - protein, 529 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKV

SEQ ID NO: 45 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 46 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 47 - DNA, 1593 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaa

SEQ ID NO: 48 - protein, 531 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLE

SEQ ID NO: 49 - DNA, 1587 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtc

SEQ ID NO: 50 - protein, 529 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKV

SEQ ID NO: 51 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgacattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 52 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYDIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 53 - DNA, 1593 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgacattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaa

SEQ ID NO: 54 - protein, 531 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYDIEFVFGLPLERRDNYTKAEEILSRSIVKRWANFAKYGNPNETQNNSTSWPVFKSTEQKYLTLNTESTRIMTKLRAQQCRFWTSFFPKVLE

SEQ ID NO: 55 - DNA, 1587 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgacattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtc

SEQ ID NO: 56 - protein, 529 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYDIEFVFGLPLERRDNYTKAEEILSRSIVKRWANFAKYGNPNETQNNSTSWPVFKSTEQKYLTLNTESTRIMTKLRAQQCRFWTSFFPKV

SEQ ID NO: 57 - protein, 1722 aa, Artificial Sequence
  Synthesized
GAAGATGACATCATAATTGCAACAAAGAATGGAAAAGTCAGAGGGATGAACTTGACAGTTTTTGGTGGCACGGTAACAGCCTTTCTTGGAATTCCCTATGCACAGCCACCTCTTGGTAGACTTCGATTCAAAAAGCCACAGTCTCTGACCAAGTGGTCTGATATTTGGAATGCCACAAAATATGCAAATTCTTGCTGTCAGAACATAGATCAAAGTTTTCCAGGCTTCCATGGATCAGAGATGTGGAACCCAAACACTGACCTCAGTGAAGACTGTTTATATCTAAATGTATGGATTCCAGCACCTAAACCAAAAAATGCCACTGTATTGATATGGATTTATGGTGGTGGTTTTCAAACTGGAACATCATCTTTACATGTTTATGATGGCAAGTTTCTGGCTCGGGTTGAAAGAGTTATTGTAGTGTCAATGAACTATAGGGTGGGTGCCCTAGGATTCTTAGCTTTGCCAGGAAATCCTGAGGCTCCAGGGAACATGGGTTTATTTGATCAACAGTTGGCTCTTCAGTGGGTTCAAAAAAATATAGCAGCCTTTGGTGGAAATCCTAAAAGTGTAACTCTCTTTGGAGAAAGTTCCGGAGCAGCTTCAGTTAGCCTGCATTTGCTTTCTCCTGGAAGCCATTCATTGTTCACCAGAGCCATTCTGCAAAGTGGTTCCGCTAATGCTCCTTGGGCGGTAACATCTCTTTATGAAGCTAGGAACAGAACGTTGAACTTAGCTAAATTGACTGGTTGCTCTAGAGAGAATGAGACTGAAATAATCAAGTGTCTTAGAAATAAAGATCCCCAAGAAATTCTTCTGAATGAAGCATTTGTTGTCCCCTATGGGACTGCTTTGGGTGTAAACTTTGGTCCGACCGTGGATGGTGATTTTCTCACTGACATGCCAGACATATTACTTGAACTTGGACAATTTAAAAAAACCCAGATTTTGGTGGGTGTTAATAAAGATGAAGGGACATGGTTTTTAGTCGGTGGTGCTCCTGGCTTCAGCAAAGATAACAATAGTATCATAACTAGAAAAGAATTTCAGGAAGGTTTAAAAATATTTTTTCCAGGAGTGAGTGAGTTTGGAAAGGAATCCATCCTTTTTCATTACACAGACTGGGTAGATGATCAGAGACCTGAAAACTACCGTGAGGCCTTGGGTGATGTTGTTGGGGATTATAATTTCATATGCCCTGCCTTGGAGTTCACCAAGAAGTTCTCAGAATGGGGAAATAATGCCTTTTTCTACTATTTTGAACACCGATCCTCCAAACTTCCGTGGCCAGAATGGATGGGAGTGATGCATGGCTATGAAATTGAATTTGTCTTTGGTTTACCTCTGGAAAGAAGAGATAATTACACAAAAGCCGAGGAAATTTTGAGTAGATCCATAGTGAAACGGTGGGCAAATTTTGCAAAATATGGGAATCCAAATGAGACTCAGAACAATAGCACAAGCTGGCCTGTCTTCAAAAGCACTGAACAAAAATATCTAACCTTGAATACAGAGTCAACAAGAATAATGACGAAACTACGTGCTCAACAATGTCGATTCTGGACATCATTTTTTCCAAAAGTCTTGGAAATGACAGGAAATATTGATGAAGCAGAATGGGAGTGGAAAGCAGGATTCCATCGCTGGAACAATTACATGATGGACTGGAAAAATCAATTTAACGATTACACTAGCAAGAAAGAAAGTTGTGTGGGTCTC

SEQ ID NO: 58 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTALGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 59 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggacttccttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 60 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTSLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 61 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcagttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 62 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTQLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 63 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccccgaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 64 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSPNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 65 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactggtttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 66 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTGLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 67 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctatgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 68 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPMGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 69 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcagttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 70 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTQLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 71 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactatcttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 72 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTILGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 73 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccggtaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 74 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSGNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 75 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggacttccttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 76 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTSLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 77 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 78 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSVNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 79 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactggtttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 80 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTGLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 81 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccatcaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 82 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSINAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 83 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccctgaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 84 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSLNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 85 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctatgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 86 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSFNAPWAVTSLYEARNRTLNLAKLTGCSRENETEIIKCLRNKDPQEILLNEAFVVPYGTPMGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 87 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactaaattgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 88 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTKLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 89 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctccaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 90 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSSNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 91 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccaccaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 92 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSTNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 93 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccatgaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 94 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSMNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 95 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctgcaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 96 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSCNAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 97 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactaacttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 98 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTNLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 99 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccccgaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactgctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 100 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSPNAPWAVTSLYEARNRTLNLAKLTGCSRENETEIIKCLRNKDPQEILLNEAFVVPYGTALGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 101 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctccaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcagttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 102 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSSNAPWAVTSLYEARNRTLNLAKLTGCSRENETEIIKCLRNKDPQEILLNEAFVVPYGTQLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 103 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctccaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggacttccttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 104 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSSNAPWAVTSLYEARNRTLNLAKLTGCSRENETEIIKCLRNKDPQEILLNEAFVVPYGTSLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 105 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctccaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactggtttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 106 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSSNAPWAVTSLYEARNRTLNLAKLTGCSRENETEIIKCLRNKDPQEILLNEAFVVPYGTGLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 107 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccccgaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggacttccatgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 108 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSPNAPWAVTSLYEARNRTLNLAKLTGCSRENETEIIKCLRNKDPQEILLNEAFVVPYGTSMGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 109 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggacttccttgggtgtaaactttggtccgaccgtggatggtgattttctcactgacatgccagacatattacttgaacttggacaatttaaaaaaacccagattttggtgggtgttaataaagatgaagggacatggtttttagtctacggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgacattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 110 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTSLGVNFGPTVDGDFLTDMPDILLELGQFKKTQILVGVNKDEGTWFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYDIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 111 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactgctttgggtgtaaactttggtccgaccgtggatggtgattttctcactgacatgccagacatattacttgaacttggacaatttaaaaaaacccagattttggtgggtgttaataaagatgaagggacatggtttttagtctacggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgacattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 112 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTALGVNFGPTVDGDFLTDMPDILLELGQFKKTQILVGVNKDEGTWFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYDIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 113 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccccgaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctatgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 114 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSPNAPWAVTSLYEARNRTLNLAKLTGCSRENETEIIKCLRNKDPQEILLNEAFVVPYGTPMGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 115 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccggtaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactgctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 116 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSGNAPWAVTSLYEARNRTLNLAKLTGCSRENETEIIKCLRNKDPQEILLNEAFVVPYGTALGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 117 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccggtaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactggtttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 118 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSGNAPWAVTSLYEARNRTLNLAKLTGCSRENETEIIKCLRNKDPQEILLNEAFVVPYGTGLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 119 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccggtaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcagttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 120 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSGNAPWAVTSLYEARNRTLNLAKLTGCSRENETEIIKCLRNKDPQEILLNEAFVVPYGTQLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 121 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccggtaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggacttccttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 122 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSGNAPWAVTSLYEARNRTLNLAKLTGCSRENETEIIKCLRNKDPQEILLNEAFVVPYGTSLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 123 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccgctaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactgaattgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 124 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTELGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 125 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccccgaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactaacttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 126 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSPNAPWAVTSLYEARNRTLNLAKLTGCSRENETEIIKCLRNKDPQEILLNEAFVVPYGTNLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 127 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctccaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactgctttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 128 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSSNAPWAVTSLYEARNRTLNLAKLTGCSRENETEIIKCLRNKDPQEILLNEAFVVPYGTALGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 129 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctccaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactaacttgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 130 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSSNAPWAVTSLYEARNRTLNLAKLTGCSRENETEIIKCLRNKDPQEILLNEAFVVPYGTNLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 131 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttcctccaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctatgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 132 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSSNAPWAVTSLYEARNRTLNLAKLTGCSRENETEIIKCLRNKDPQEILLNEAFVVPYGTPMGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 133 - DNA, 1722 bp, Artificial Sequence
  Synthesized
gaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagttccggagcagcttcagttagcctgcatttgctttctcctggaagccattcattgttcaccagagccattctgcaaagtggttccggtaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctatgggtgtaaactttggtccgaccgtggatggtgattttctcactgacatgccagacatattacttgaacttggacaatttaaaaaaacccagattttggtgggtgttaataaagatgaagggacatggtttttagtcggtggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctc

SEQ ID NO: 134 - protein, 574 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSGNAPWAVTSLYEARNRTLNLAKLTGCSRENETEIIKCLRNKDPQEILLNEAFVVPYGTPMGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 135 - protein, 530 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVL

SEQ ID NO: 136 - protein, 532 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEM

SEQ ID NO: 137 - protein, 533 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMT

SEQ ID NO: 138 - protein, 534 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTG

SEQ ID NO: 139 - protein, 535 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGN

SEQ ID NO: 140 - protein, 536 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNI

SEQ ID NO: 141 - protein, 537 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNID

SEQ ID NO: 142 - protein, 538 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDE

SEQ ID NO: 143 - protein, 539 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEA

SEQ ID NO: 144 - protein, 540 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAE

SEQ ID NO: 145 - protein, 529 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTQLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKV

SEQ ID NO: 146 - protein, 536 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTQLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNI

SEQ ID NO: 147 - protein, 753 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVGGGGGGSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 148 - protein, 762 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 149 - protein, 814 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGLGGGGGGSVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 150 - protein, 807 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGLVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 151 - protein, 769 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVGGGGGGSVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 152 - protein, 762 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 153 - protein, 762 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVVEPKSCDKTHTCPPCPAPELLGGPSVFLFPPKPKDTLMISRTPEVTCVVVDVSHEDPQVKFNWYVDGVQVHNAKTKPREQQYNSTYRVVSVLTVLHQNWLDGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 154 - protein, 762 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 155 - protein, 763 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 156 - protein, 764 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 157 - protein, 765 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 158 - protein, 766 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 159 - protein, 767 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 160 - protein, 768 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 161 - protein, 769 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 162 - protein, 770 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 771 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 164 - protein, 772 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - protein, 773 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 166 - protein, 762 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVVEPKSCDKTHTCPPCPAPELLGGPSVFLFPPKPKDTLYISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 762 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVVEPKSCDKTHTCPPCPAPELLGGPSVFLFPPKPKDTLMISREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 168 - protein, 762 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVVEPKSCDKTHTCPPCPAPELLGGPSVFLFPPKPKDTLYITRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 169 - protein, 762 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 170 - protein, 766 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 171 - protein, 769 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 172 - protein, 762 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVQEPKSSDKTHTSPPSPAPELLGGSSVFLFPPKPKDTLYISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 173 - protein, 762 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVQEPKSSDKTHTSPPSPAPELLGGSSVFLFPPKPKDTLYITRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 174 - protein, 762 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVQEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 175 - protein, 766 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTQEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 176 - protein, 769 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTPLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIQEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 177 - protein, 762 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTQLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 178 - protein, 769 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTQLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 179 - protein, 807 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTQLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGLVEPKSCDKTHTCPPCPAPELLGGPSVFLFPPKPKDTLYISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - protein, 807 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTQLGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGLVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - protein, 807 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTALGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGLVEPKSCDKTHTCPPCPAPELLGGPSVFLFPPKPKDTLYISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 182 - protein, 807 aa, Artificial Sequence
  Synthesized
EDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESSGAASVSLHLLSPGSHSLFTRAILQSGSANAPWAVTSLYEARNRTLNLAKLTGCSRENETEIIKCLRNKDPQEILLNEAFVVPYGTALGVNFGPTVDGDFLTDMPDILLELGQFKKTQILVGVNKDEGTWFLVGGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGLVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

What is claimed is:

1. An isolated polypeptide having the ability to cleave cocaine, comprising
    a butyrylcholinesterase (BChE) polypeptide having the ability to cleave cocaine, consisting of a variant of SEQ ID NO: 26 or a fragment thereof; and
    a second polypeptide, consisting of the sequence of SEQ ID NO: 18;
    wherein the variant of SEQ ID NO: 26 or the fragment thereof includes between 5 and 8 amino acid substitutions;
    wherein 5 of the amino acid substitutions consist of A199S, F227A, S287G, A328W, and Y332G.

2. The isolated polypeptide of claim 1, wherein the isolated polypeptide having the ability to cleave cocaine comprises an amino acid sequence selected from the group of sequences consisting of: SEQ ID NO: 169, SEQ ID NO: 170, SEQ ID NO: 171, SEQ ID NO: 178, SEQ ID NO: 180, and SEQ ID NO: 182.

3. The isolated polypeptide of claim 1, wherein the BChE polypeptide comprises the amino acid sequence selected from the group consisting of SEQ ID NOs: 46, 48, 50, 58, and 62.

4. A pharmaceutical composition comprising:
    an isolated polypeptide of claim 1; and
    a suitable pharmaceutical carrier.

5. The pharmaceutical composition of claim 4, wherein, from the N-terminus to the C-terminus, the isolated polypeptide comprises the BChE polypeptide and the second polypeptide.

6. The isolated polypeptide of claim 2, wherein the amino acid sequence is selected from the group of sequences consisting of: SEQ ID NO: 169, SEQ ID NO: 180, and SEQ ID NO: 182.

7. The isolated polypeptide of claim 1, wherein, in addition to A199S, F227A, S287G, A328W, and Y332G, the variant includes from 1 to 3 amino acid substitutions selected from the group consisting of P285A, P285E, P285G, P285I, P285K, P285N, P285Q, P285S, L286M, and E441D.

* * * * *